United States Patent 10,407,724 (METHODS AND COMPOSITIONS FOR SCREENING AND TREATING DEVELOPMENTAL DISORDERS) - sequence listing, part 42

SEQ ID NO: 641 - DNA, 660046 bp, Homo sapiens
atcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctcctcgaaagcttggagcccagggtttttaaggataatttggcaagctgagggccagggaatgtatgctactgattggttggagatgaaatcactggagtgttggaactgtcttcacgtgctgagtcagtttctaggtgggggtcacaggacgagttgagtctgttccttggtatgagtcatggtccagatggcatcagtcagtttaccagaatgcaaaggtctgaaaaatatctcaaaaacccatcttagggtttacagtggtgatgttatctcaaatcttgtgacctccagcagtaaccaagctagggaacaatggctggttatctcttcttcactgtgcttattacttagcagaattcaggcccttatcataattctaatcttattgactttcattagttttacaaatgcagtttcagttcccaagcaagaaggggaccagtttcaggaagggactattatcatccttgctttaaagttaaactgtaaactaaactcctttttagttagcttgacctacacccaggaatgagcagatagtcagcttctggggtcagaagcaagataaagtcagctgtgttggatttctctaaccatcataaccttagcaaggtggtttcagttctctgagtctcatatactgtgtggcccctgtgcttctgcacattaatacatttatatgcctcttcccctgttaatcagtctaatgtcaggtcatttcagcactttcaaatttcagagccagagggggaggaaaaattatcttcacacctatactctctaagaccaaaaagcaacagacattctgccacatgctacaagacggataaaccgacaaatattatatggttccacttataagaaacatgaagagaaagtagagtaaaggttcccttgtccccctctgccacagagggagtggcttgcttcttcagcgccctgctgctcaaacctctagggggagcatacagatgggcacgttgtggggctcggaccccatggcagtgtctagaggtgtatgtttacagctcctgaagccccagtgggcatgtgttacaaggtgctcttttaatctagccgtctgtaggcagcttgtgttagtcagctcaattagacccccttccttatcacaaggacaaagggatttctatatcctggggtttcttgctttggtgaactggaagaatcagatcacatgtaggcttggagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctgagcccaaggtaagccatcatatcccccgtgacctgcacgtatacatccagatggcctgaagcaactgaagaactacaaaacaactgaaaatagccagttcctgccttaaccgatgacattgcaccattgtgatttgttccctccccaccctaagtgatcaattgactttgtgacaataccccctccccgcccttgcgataatggactttgtgatattcctccgcccttgagaatgtaatatcctttgtaatatcctccccacacttgagaatgtactttgtaagatccaccccccactagcaaaaattgctcctaactccaccgcctatctctataagaactatagataagttcttatagggataaacctataagataaacctataagaactaatgataatcccaccaccctttgctgactctcttttcagacttagcccgcctgcacccaggtgattaaaaagctttattgctcacacaaagcctgtttggtggtctcttcacatggacacgtgtgacaccctccacgtcctcccgatgtccggccacttgtcttcttccaccaatgtgttcctctcaccctccagctgcttctgtctgtgccttgctagggtcttgggtttttataggcccaggatgggggcgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcatttaaagggaccacactcttcccttcccagcactcccgtatcacagtcagtggtggcactggattctcataggaccactaaccctattgtgaactgcacatggcagggatctaagttgcatgctccttatgagaatctaatacctgatgatccaaggtggaatagtttcatctagaaaccatccgcccccctcactctatatccctggaaaaactatcttccgcaaaaccagtccctggtgccaaaaaggttggggaccactgttttcagctaaaaagtctgtcacgacttgagctgtggctcatgcctgtaatcccagaatttcgggaggccgaggcagggggatcacgaggtcaggagatcgagacttctccatcctggctaacacggtgaaaccccgtctctattaaaaatataaaaattagccaggtgtggtcgcacatgcctgtagtcccagctactcgggagggtgaggcagaagaatcacttgaacccaggaggtggaggttgcagtgagctgagattgtgccactgcaccccagcctgggcgacagagcaagactgtctcaaaaaaaaaaaaaaagtctgtcatgacttgatatagcatcaataagaagctaatacataaaccactcgatgaggagtttagaagatgaagttgaactgaaagtacagcaaaaagaaaactgactccatcatgcaagagactgctcctacagcttggggttggaagtaaataaaataattaaaggcacagtgacttcacagcacgcaataaacatgtattaagcacctacttcctaaagcccactgcagtcaatgataattcagtcaagctgaaatcatcatcatccaaggttcgtttgtaaataatttaacagtttggagagaatatgtgaagaacaacagttttatttccaagaattcatgaccttatctagagaaagtttatgaatggacagagaagatagtcttatatttggcatgatttcctacgcaggtgaaagattcaactgcccaaaaatatctgatctttggcttgttctaatatagcaaatgcccactaataaaaacctttcaagataaatcttcaaaaaagtattaaaatggaaatgttaacaagaaaggtagtgcccactaaaattatagcataggttagggaagagaaattgccgtggagcagggcaaaaaatcattagctggaaagataaccaacccagtttggagggattaatgcagtaattgatgaactttacctttttctttgtctgggtgctgaagtatgactatttttataagacagatctttctaggcagtccagttactatatgtcaacacatagccttgtaaaagtataatatcctataaagaaataaactctaaactcctcaaatagctattcttctctaatgtttacactgtatatttttatctgataggtaagggtcaacactgtttgcatcattaactggcaaggaataatcgaaattactaattacatttagcatgtctcatattgatgaaacaacagatgtttaaggaagaagcttctttaatatctactaacattatattatgtttcattgtattacacaaaactaccaataaggctaaagcagttgtaccacttttatttaccttacaacaaagaataaatagcttgacaagatccttttaaaaaaaaaataaagtgccattactaattctgtaaaccagtaaaagttaccaaaagaattttaataaaaagatctcaagacccccactgtattttgtaaaatattaaaggcagtaaaatgtaacaaaataaaatagaaaaggtgaccttcaaatccatgaaagaaataagcaaaaaaacaagatgaccttaaaatgaaagttctaatgtcatttcattattttattgtaagtcacagagcccccaggtctatattaaaggcaatatttataagacttaaaatactaaaaaaagaaaaaacagaaaaagactaaaaaccatctacaataattcagaggtatttgaaaataatacaaagcaattaaaaacagtaaaatagaagagatgattaagtctaaaagcagctcagaaaggcctacagctgagctactgctcagggagagggaagctgagctcaaagccccaaacatcaagtgcaatgtgaggaacagaacacactcgaaagctgggggactgaatctgagtcagaagcccctgaaccaagagcgccaagagcagaagatggatgtgccagctcaaaagggagagagcaaattcacctttcctctgcctttttggtctactcatgccctcaatagactgatgagggtgatctttaccagtttgcacattcaagtgctcatctcttcccggaccactctcacagatacaaccaaaagtaatattataccagctatctagacatcccttagcccagttaaccatcacaagtaaggaatggtgacatggaataccggagacagaatagcatgacactgtgaaggccctttgatgataagccacagatcaaagaatactagggcaaagatttttgcataggaaaatgacataatctctctactacatatttaacctgattaaaatggatttttgcacagacaactaaggaagaggccttgttaggatcttgtttagaataaatagataaatatatatattatagttggataggactttaaatattgcctgatcccattccttcatttatcagactcagaaagtataatctcctcggggtcagctggaaaattagtgacaaaggctacaatgtttgcctttttttttaatttatttttttgagacagagtctcattctgtcacccaggctggagtgcagtggcatgatctcagctcactgcaacttccacctcctgcgttcaagggattctcctgcctcagcctcctgagcagctgggactaccagagcccaccacgcccagctaatttttgtatttttagtagagacggggtttcgccacgttagccaggctggtctcgaactcctgacctcaagtgatccacccgcctgagcctcccaaagtgctgggattacaggcgtgagccactgcacctggtttacaatgttttcaaacaatgaactcataagtactcttatatttattatgatttttttttaagatagctctatctcccagaatttctacaaccacctctttaatgaactgaagtctttctttctttctggccacaaatatttactgaacccctactatgtgccaggcactgttctagaggataataacaaaattaattctctggttagatctaaaattcaaaagaagaaaaaaaacaataaacaaacacatacatcacacagtggtaagtgttaggaaggaaaatggagtgagatgacccggcgcagtggctcaggcatataattccaatcactttgggaggccaaggcaggcggatcatgaggtcaggagttcgagaccagtctgaccaacatggtgaaaccctgtctcttctaaaaatacaaaaattagccgggcatggtggcgcatgcctataatcccagctactcaggaggctgaggcaggagaatcacttgaacccgggaaacgaaggttgcagtgagccgagatcgcgccactgcactccagcctgggcaatagagtgagactccaactcaaaaaaaaaaaaagaaaaagaaaagaaaaatagagtcagaaggaaaacaagtgcagaacagaaggtattataagtacacagagagcagccacagactaccatctcataagatggtctgcatgaaccaggagcagtggcttgtgcctgtaatcccacctcctagaggggatgagatggtgggatcacttgagtccaggagttcaagacaagcctgggaagcataacaagaccctacctctaaaaaaatgttttaaagtagtcagatgtggagacgcacacctgcagccccagctacccaggagcctgaggcaggaggattgcttgaggccaggagtttaaaactaagctgggcaatatattttatctcaaaaaaataaaaaaaaagatagcctgcactataagaaatccagtagaagagtggtccccaaagactagacaataaatgagaaaatagggagcaggtaagcagcctgtttaaaagagggagggagaagaaaatgaggttgaagtctaagtttcagaacaagtagaatcttatagaccactgtagaaactttgccacagaagtttcccccagaaacagtgcaaaccaggagacaatggaacatctttaaagtgatgaaagacagaacaaaaagtcaagccagaattctatatctagcagaaaaatcattaaaaataaaggcaaaacaaaaattccagacaaatgcaagaagaattgggtaccagcagacctaaagctagaaatttttaaggaagttcttcaggttaaagagaaaggataccagctggaaacagatgaatacaaagaaatgaagagtgctagaaatgttgtaacaatgtaccgtggggtttataacacgtacaagtaaaatgcatgataaaatagcacagaaaataggaggggagaatagaagtaaactattgtaaggttcttacattatatattaaatttatattattttacagtagattatgatgagttagagatagatgttttaaaccaaaagcaacaacaaacaaacaagtatagctaacaagtcaacagaagagataaaatggaatattaataaatactcaaaggaagacagaaaaagagaggacaaaaacaacaaaaataaattaaaaaaataaataaataagtaaacttactaaaacatggcaagaaaaatgcctaccaagcaacatatttaagctggtctgtgttagtgcatctgttgggaataaagctgaaaaccaacatctttactaattgatataaatgtctgcctgaagttttcacagatgatttactgtaatatggtcattctacattgctttcctttccatctgtcataaaatagctgtgtatgattttcaaaattaaaaaattaactttaattagccaactagtttactgataatatcttctcactcaaataagtttttgaactactagacatcgccaaataaaaatagcagttgaggatttgtaaaaagaaaattaagtcaaatagttatttgcaaaatcgttttatcatctttggttcatggaaccattatgtttatcttatatatgctacagcttttttatcaacatgcaaaaagttgtcacatcaacatacccacttgcaaaaatgtaattatactttatataatttcttatatactttacatagcgataatagtaatcaagtactaactatgatagaattcatattggcggagataaatggagcaaaataatattgcttactttgtaaaaataaataattatcttattgatgttgccatttatcctacttgattctatttaatcggcaaaaaccccaggctcaatgtaaaactggtcacagcaagactaggtcagatctctttccaaagtgccagtccagacttctgagtgaccatgggcaaagcacatgcggtgagtggtagaggaaccccaaaactttttcaacacacaccagaaaccgcaaagttacccccacccacatatggttccattcagaaacgaccacagctctcctggtaccggagatacaacaccaacctagataacaaagaccacagagtacatccatctcctcagtttggtctgtaactggagtatcttctacatctccacagcacagatccttggaacgccactgtaacataagctcagcactcaccattctcttacatgcctaaggctttctacagtaagccacagccactctctgcctgagagtgttcactggctgggagcttgctgagacaggccagaaaccagagctggacaagagtgaatgaataaatactcccgcttctttgccctcaggtaagataactatgaggtagattccatgtagcttcacaaaagtacccaatgggattgagcttcagttgccaatagttgcggcctgttcattagcataccctgtagtggcttcattctgtcttacttactcagctctttacaggtgcttcctgggatcatctccctaataaactacttgcactcaaatccttgattactttaatgccatccttcagaatgatgccatttcgtccaagaacaagggatgcctttagttttgttcagttctactttcgggcctttcaggagtgctttaaagttttcttcctgtaagttttgtacatttttaaagtttaattgctgagtattttatctttttttcttgctattgtaaatggggttttctcttcgattatatctctttttttttaagactagtcaagcgcagtagtaacaagtggagaaagactagaacaaggagtttaatctataactgactgaaaagtcaattgagataactcagttggacctttggaccagccttccttataccttctaactcattattgtttacatttatgaaggcttttgatttttccatgttaattttatcatacctattaccctattgagttattttactgagttgggattttttaacgactttattgagaaatcatttacatgccataaaattcactgattttaaatgtactattcaatgggttgaagtatatttagagagctgtacagccatcaccacaatgtaattttagaacagtttcatcaccccaaaaagaaacctttaggcccattaggagttactccctatccctaccccatctcgacctcccagccctacacagccactaatctactttctgtctatatagatttgcctgttgtggatattttacataacgaatcatatgacatgcggtcttttatgtccggcttctttcacttagcataatgttttctgaggttcattgagtaaggttttatcattgatttactagggtttttttaagtaaaatgtcatatgagctgcagatagaaatcattttccaattacaatgcctccaactgtttcctcctgtcaagtgcttttgttaatactgccagtacaatggtcccaacctttgtgggaatattcttagtgtcttcctaataaagtaaagtgctgattatttgatactttaactctgagaggaaaatcatatgtttctatatatgtcaccaccatattacattaactagaagccattatttgttcatctacaacaggataaaataatgtctgccctctctactttacagaaatcctaaaaagaaaatatatataaaatattttataaacaataaaactctatgtaaatttgagagcctatttactataccataaaaataattttagaaaccactgaactcctttgaaagtgtgtgtttttaactactaccaaggagagagaagttagtagacaagaagcaaggcgactagatcattcagccatccaggtatgtaaacaaagaaggaaagaagctagctacagaaagcaaatgtcatattggaacacactgagttttctaagttcctctgacatatttctggtcacagaactatcaccaaacttaaagacctaaaggacttctaatattaaacattaaaatagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaatgtgagcatacatacatttaagaaagattaagcaggccaggtgtcgtggctcatgcctgtattcgcaacactttgggaggccaaggtgggaggatcacttgagcccaggagttcaagactagcctgggcaacacagggagactccatctctacaaaaattttaaaaatcagccaggcatgcctatagtcccagctgctcaggaagctgaggtgggaggatggcttgagcccaggaggttgaggctgcgatgagccatgactgtgtcactgcactccagcgtaggtgatacagtgagatcttgtctcaagagaaaaaaaaagtaaagcagaagaagaatttagaatttagaggtatgcttaaaaggttaaaagattcttaaatccttaacttattacagaggaattccaaatacagacatgaaaatgggggatatctacatgactgaaagtaactgaaaatatctgcttatctactcaatgaaatgttcaaatataaaaaaattttagacctcttgacaatgtaggaattgacagccagtaccattattagtgcttatttgttaaagtaagggggaaggaaggtagttcagttagctcttgtaaacaccctcggattgatttgttcaatcctggaaaaaattggtctatgcaatagtaattttcacatttttagagttcctttaacctactgtgtaaagtatgcagtgggaaggaagtcaaactagttacttaatacttatctttaagttgaattcaaattagtctcagagttaactaaccagtgtaagagttagggtgtttttcagttgcaaataacaaaaaaacagatttgcattaaaaagaaaagaaaacccagatagtgggcaggtttcagagttggttagaaataataatgacaacagtaacaacagcaaatactatctgtcaggtactgctctctccattttgtgtgtattaatctatttaatccttgccacaactttctgagagttgttatcctcattttacagataaggaaattatctaaaggtacagagagcatctattacatttgcccagcatgccacagttagtgagtagcagagctggcattcaaacccgtgcaatctagaccagagcccatgctcttaactgctgattcaaacccgtgcaatctagaccacagcccatgctcttaactgctgattcaaacccgcgcaatctagaccacagcccatgctcttaactgctgattcaaacccatgcaatctacaccacagcccatgctcttaaccgccgatgctctgctgcctcgtgatggcttctcaggctgtgactcctttctctccagttccctctgctctgccctcttccagagctagcttgcagctcagtctggctccccgtcaggaatattatagatgccaatgggtcctggaactaccctgtactcatataaaaggggagagcacaagcattccttcctaccaaacaaaagctctgagtctcactttaataggacagatcaggtattgttcccaccacagaaccaaccaccgtagacagggaataaggttgcccagagttatctatgccaatgggaacccaccacaggtacagtaataagggaagtctaccccaccaaacctgcaaaactgccatgtaatgagctggattggaaagaatgttgagtagaagccacactgtccactgcaaccagtgatactcttgggtgatacaactctaagaaagggaatcaagatataaccttatggtataacttactaaaattcatcaaatgtaagatgctatggattgtaagacatgccattattaaagataccattaaaaacagtatagcactgccaagtatcatcttaagaggccttcaaatgtaggacgcatcctaatttcagttatgtcaaaaatgtaggaggaaacgtccatcttacaataaaacaaaaatatgaagtgccatcagctggagttgtaaaaatccataactgctttcccacatatatctacataagtctaggctatgactctatacacaggctgagaaatgaaacagcaatcaaccctgctgtgttcccagaacttaagatgaaagatattaactaaaagagtcgtcagaggcctcactcctcaacccctcaatcaaacaccatgtcagacaagcaatatccaccatatgccaggcacagtgtctgggtcctacaagggaaaatgtcttaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaatggtaactcctgcctcaaggatatgactggcaagtactaaataatcatacaagaaacggaatgaagtaatgctgttaaatggatatcaataaaatacaggggctcagaaaaaggaaagattaatatagactaactggaacagagacagttccagcatcaagataacatcagagctgcctgggcatctgtaagaaatgaggatctatttaagagaggaaggcaagaagcaagagtaaataacatggaggtatttcagatcacagtagtagaaatcaagtacttgagttgaactagagcgaaggccgtatgtggcagagtggactaaaaagctagaaatatagtttggagccagcacatttggtaggcaagaagagacactgaacattcttgggcagagaaatgacattatcagagaggttggagaagaatccctaacgagttgtttgcagacactgggcttacggggcttgtgggacatctagggagttttcactgaaactgcccagaagccacccagatataagtatggaatccacagaaagatctaagctaagagtttttatctgggggtcatcaggactagatgataactgaagttatgaaataaatgacattttcttaggaggatctgacatgccagaaaaacaaaggagcccagagaaattacctgaggaacgtcaacattagtggaatgagcagaagagaaggagcttatgtagaaaaagcagcagaaactacacaacaagaggaaggaaaaccaggaacgtgggaaaagagtatgtaagaaaagagagaagttaatactgaccagtttcacagcaagatagaataagaactgaaacataacccctgagatttagattattgatgagctggctgaaagcagtacacatggactagcaaggatggggtagtccacacagggaggtcagaaaaggatgcttagaaaagattgcttttgagctaagaagttaaccagataaacaggaaaaatcaccaaatgtaagggaagaaaaatagtatctacaaagaataggctggatccaatacaaaaatatgtatcttaatcaaaaaaaagaaaaaaacaataaacgcacacataggatttttacattcaacaagcataactaatttgttacctcacacaaattgatcttttgctttaattacaatgctaactttttaagaaaaagaacccaattaaaaatccagcaaatacacagctcagcaaaatttgatgaaaaggtatgcaaataagccacaccttttgtatgacctcttgctaaaaggagcaactttaggccaggtgaggtggctcacacctgtagtcccagcactttgggaggccaaggtgggtggatggcttgaagccaggagttcgagaccagcctggccaacatggtgaaaccctatctctactaaaaatacaaaaatcagccaggcatgctggtgtgcgcctgcagtcccagctactcgggggaggctgaggcagcagaatcgcttgaacccaggaggcagaagttgcagtgagctgagatgccaccaatgcactccagcctgggcaacacagtgagatcccatctcaaaaaacaaataaataaataaaaggagcaactttacatatatctgctatacaaattactctccatttctgcaacaatctgtttaactctaggcaacaagttcaatctcaaatttcattttgactcaattcttttcttaaaaaggattccatattttataatagaaagagccatgaaaaaactctaacttttatttattttaggaattgggaaaatcattccattcctaaaatccgacatatctgactatactctggaaaaaagtatatagtctggcaactcaatagacatgtattttttaaaaatctcactgaataattgcagataagacaaacaagagtaatctaacaattatgccaaacttagattggactacatgtgtgaaagtactacctctctagcactttctccaaggaaactatcagaaccatttattttccactgcataatagcagaactatcagttatgtgacatcctataaaaagacaaacacaatttctaattatatccattctttcattttaattactctagagagtgattacatatttaacttggctatctttaaaaaattaagttgctttaatgaaagtattttagatagctacaccaccatacatcaattagaaagttaatcattccacttgttctcacaaaaagattttaaaggaggtggagaggtggtgtttggtgctttataaaagttaattagagggcacccagaaagagagatcatccaggaaataaagtttatcaaaaatccaaaatatgtaatctgcacagtgtcaagaaacagcaggagattctctttaatgagtttactcatgttcactttaaaagaaaatcttcagttcacgatgtgaggttgagttttaaatatactggaagacttctctgtgtaacagactgtaagactccactcgctcgcttggtcttgactgcctaactgatggcagactattatctaaagcatattcctactctaaaggcagccttctattttacagtgatcttgctgtatacttcacagtcacactcatcattacaaaacattccgaaagctttttttaataagttttcagtgtttgaattatcatgatcactccctcaaattaattactaatatgataagaaataatcaaggttaagttgatacttaatttttggccaaagcaggttcaatggatctatcctagatcaatagataagcttaagaatgcatttctggaagtcctagccagagcaatcaggcaagaggaagaaataaaaggcatccaaacaggaaaagaagtcaaactctctctctttgcagacaatatgattctatacctataaaaccctaaagactctgccaaaagactcctggaactgataaatgacttcagtaaagtttcaggatacaaaattggtatacaaaaatcagcatttctatacccctataacattcaagctgagggtcaaattaagatcacaatctcacttacaatagacacacacaccaatatctaggaatacatctaatcaaagaggtaaaagatctctacaaggaaaactacaaaacactgctgaaagaaatcagagatgtcacaaacaagtggaaaaacattccatgctcatgaattagaagaatcaatatcactaaaatggccacactcgcggtggctcacgcctgtaatcccagcactttgggaggccaaggtgggaggatcacttgaggtcaggagtttgagaccagcctggacaacatggtaaaaccccatctctactaaaaatacaaaaattagccaggcatgctggcacgcgcctgtaatcccagctactcaagaggttgaggcgggagaattgcttgaattcaggaggcagagatggcagtaagccaagatcgtgccactgtactccagcctgggtgacacagcaaggctggctccgtctcgaaaaaataaataaaataaaatagccatactgcccaaagcaatctacagattcaacgctatgcctatcaaactaccaacatcatttttcacagaattagaaaaaattattctaaaatatagaactcaaaaagagcccaaaggattgcccaagcgattctaagcaaaaggaacaaagccagaggcatcacattacccaacttcaaagtatactataaggccaaacagtaaccaaaacagcatagaactggtacaaaaccaaacacatagaccaatggagtacagagaacccagaaataaagctgcacacccacaggcatctgatctttaacaaagtcaccaaaaataagcaatggggaaaggaccctctagtcaataaatggtgctgggataggctacctatatgcagaagaatacaactggacctctacctttcatcatgtacagaaattaagtcaagatggataagatttaaatataagaccacattctacaagaatcctagaagaaaaccattcttctaaaggattggtttaggaaacaccattctggacatcagctttagaaaagaatgtgtgactaagtcctcaaaagcaattgcaacaaaaacaaaaattgacaagtggaacctaattaaaataaagagcatctgcacagcaaaagaaattatcaacagagtaaacagacaacatatagaatgggagaaaatattcacaaactgtgaatttgtctatttgtcatccgacaaaggtctaatatccaaaatctataatgaacttaattcaacaagcaaaaaacaaatgaccccaatacaaaatgggcaaatatatgaatagacacttctcaaatgaagacacacaagcggcagacaaacatgaaaaaatgttccacatcactaatcatcagagaaatgcaaatcaaaaccacaatgagataccatctcacacctgtcagaatggcttttattaaaaagtcaaaacagaacagatgctggcgaggctgcagagaaaagggaacgtttatccactgttagtgggaatgtaacctagttcggccactgtggaaagcagtttggagatttctcaaagaacttgaaacagagctaccatttgacccagcaatgccattagtaggtatctatccaaaagaaaagaaattgttctaccaaagagacacatgtacgtatatgtttgttgcagcactactcacaatagcaaaaaacacggaactaacctaggtgtacatcaatagtggtttagataaagaaaacatggggtgtgtgtggaatagtattctgctccccatggaatacttagccataaaaaaagaacaaaatcatgtcctttgcggcaacatggaaacagctggaggctattctcctaagcaaattaatgcaaaacaataaaaccaaataacatgtagttcacacttataagtgggagctaatcactggtactgctggacataaagacggcaacaatagacactggtgactattaaaggagaagaggaaaggaggaggcaaggattgaaaaattattgggtactatgctcactacctgggtgacaggatcatccctatttcaaatctcagcattacacaatatacccatgccacaaacttgcacatgtattccttgaatctaaaataaaagttgaaattatttttttttaaagaatgtgtttgtgattatctgaaattattgcaaaatgtatatacatttttttccaaagaggtttcacggatttcataagttaactgttttattctatgaagagaccatggaataaacaaaacaaagcagcaaaatgttaagtgaaaactttatattcagactctgaagcttctttggtaagggtagtgtgttacgcaaagaggtattctgagtaactgtaatactagataaggaacagtcaggacaaagccactgcttttctctaagttaggaaaacatcaggaactcctgagaattccaaaatagcttgaatgaggaagggggaataagggaagagtaatagcgttgagactctaaatgatagaagaattccaaggagaagatacaagaattccaagaattccaaggagaagatacaagaattccaagaattccaaggagaagatacaagaattccaagaattccaaggagaagatacaaggaaactggacaaaacacgctaaatgaagctacattaattagaatgtcccacgtggcatttgaatttccctctattagagtttttgctacatttccctgaaggtttatcgagggcagacactgaccttaatagtctttgtatcacgggttccagcacagtacttctcacatagttgttactcaacatttcctgggtcagtaatgaaaacatgggttggaaataggtggcaagtttttttaaaattattaaaccagaagctttcagtgggtagtagttacatattcaaatttccttcacccacttgagagagaaaatataaaggctatgaaatgtgtcgggagaaaaactatgaaccattctttcttatttgaaaaaaaaaaaaactatacaacaatagaagaaagttgaaaaagaacctaatcttccttcatggaaacatggacttaaacaaaaaaagaacctaattttcctaaagtgaactaaaagttacaaatttcaatctccaataattgaaggcaagaactttgttcttatagactatctcaggcagcagtttaaaaggggggcctacaatgttttcccctttgattttaaaataattttacacttacataaaagtcacaataatagcacagaggattcccatctaccccttcactcagcttcccttaacattgacatcaccacagtaatacatagaaagtatctaggttcctgcctccctagtctcctccgatctgtcataattcctaagtctttccttgtctttgacacttgatacttttgaagagtaatgatcagttatttaggcaggtgtcttgcctaaatcatgttctttttctgttccacaaggtaaagatgtatttagatgtcctgcttcgttagtctcctccaatctgtgacccaacatgctcccgcccccaagggcaggtttacttctattacttctattttccccaggtgtaaagggttttcaccagagccccaaaggtaatggtcattgttttgtcctttctctgctttcattcagtagaagggaaaaggacgatagggaataagggtcctgccagagtttctttcttttttttttttttttttgagacagagttttcactctcgcccagactgaagtgcagtgacacaatctcggctcactgcaacctccacctcccgggttcaagcgattctcctgcctcagcttcccaagtagctgggattacaggcacccgccaccacacccagctaattttttgtatttattagagacaaggtttcaccacgttggtcaggctggtctcgaactcctgacctcgggtgatccactcacctcagcctcccacagtgctgggatttcagagtttcttactgtatctgcagcagctgctcttctcctagagacaaagaatgctttctcaggaatctcacctgtctttttgggagcacctggtagagtttttggagaaaaagcctacaggtgggtatgaactcccctcatccacagttcccagggtcttcacactttcttgccagcccacatgcagcatccatcaatttggttaactattctagctgaatgcttaccagtgtccagctgtgggtgccccaggtaagcaagtgctgatgtctttccctacatctgtctcttcttagacgtcaagctagccgattgccctataacctcagcaatctgatgggttaaaaaacaaaagtcatgaacttgtcattgtccagatgtttctgtgtttagtcttgcttttaagattagaagccatgctttttctgtacacaattttgtttttattaatgcgtgaatttgtttgctaaaagataacgctatgaaacaaatttaaagtttattgaaaaatcaacttaaaagcagcattccaaaatattctaatataatttttaatcttaaaacttagagttttgactgttgatcactgtcattttttccagctgttgttatatcaagaaaactctcattatttccataacaataaaattcaaaactgaaatgcaataatgcatgtggacataaattatactgagaattcaacctaataaaaaacacataacagctgacaatgatttcttaaaagcatttgcttaaagtttgtcagaatgctgggagaataccaattacgtattcatagtcctcataattttgttttacaaaatattttctcaaatctcttgggagattactatagggttaaaagctgttttaagatcaaagatcaaatagaggggggaaaaaccctgtaattctctactgcagctcattgatctttcccatctgctatgcaaaaaaggagatgcatgttaagtttgaaaaaagaaaatctttttaactaggaatgacagcatactgattctggcaaacgttcagagggaatttttatatatgagatccaactcccttttgccaaaatataaatgatgttaacaataggaaaacaaaatctagtcagtagtctcttatttatatatttcttcctgcaaatatatcgtatgatcagatttctaatataaaacacacatagtaaaataaattttcaaccatcaagagcacaggcttaggggtgaatgataagagacaagtggagtaagacactgaaaaacgaagtcaactcaggaccagaggaactactttcctggtactcttccctcccttgtatcctccagggattgattccaggacaccaaccccctccctggcccccagcacggataccaaaatccatggatgctcaagtcccttctataaaatggcatagtatttgcatataaactatgcatatcctcttgtatactttatatcatccctagaatacgtataacagtggtccccaaccgttttagcaccagggaccagtttcgtggaagacaacttttccacagatgctggggcggggggcggagtggggatggttttgggatgaaaccatcagatcatccaatcatccgatcatcaggcattactttgattctcatactgtgagatctagtgtgcaacctagatccctcacatgcacagttcacaatagggttcacgctcccgtgagaatctaatgccgctgctgatctgacaggagacagggctcaggcaataatgctcgttcacccgccactcactccctactgtgcggcctggttcctgacaggccatgggagtggtaccggtcctcggcccgggctctggggacccctgactatgctatgtaaatagttgttatgctgtattggttttatttgtactatttttattgccacattgttattttcgggggggggggttcccaattttttatttttatttttttaagagacaaggtcttgctatgttgcccaggctggccccaaactcctgggctcaagcaatcctcccatttgagcctccctaggaaatgagactacaggcaaacaccaccacacccagtccaaatattttgaatccaagcctggctgcatccacagatgtgaaaaccatggattcaaaggattcactgtatagtccaacaattcaagtttccgtggactttatgtaaaagcctagaagccttctcatgtatcttcaccttggaaacaataaaaaatacttcccaggaggccaatgacatggcccattttttagaacagaagcagcacattttatctcctgagacaaacgctcataggcacaccaacaattatcacctttggtaaccctcaaagtattttagcatggggcctgtttctttccttagtgtgcctttagcttctctcctctcacagtcactgaattctacacttaaaatgggtgagactgactcttaagaaaaaaaagacagttgtatattctcacactagaagcacaataaatgtgctagaagtactaagtactctggtaggcgggggtgggcggattacttgagcccaggagttgaagaccagcccgtgcaacgtggcgagaccacatctctactaaaaaaacagaaaaattagctgggagtggtggcgtgcccctatagtcccagctaccagggaggatgggatgggaggatcacttaagcttgggaggtcaaggctgcagtgagccatgatcgcaccactgcactccagcctgggtaacagagtgagaccttgtctcaaaaaaaagtgttttagttctttataagtttgatgatatttctatgatcagaagtatgtcataggaacttaactcttgtttatatccattagcctgtggtaaaatcggtttcgttagaagtcattttgcttgaagtttacaacaatctattgatgatgttgagtgaggacttactctacatgagaaataaaaagaagaaaataatcccatcacctagaaagacaaccactattaaaccaatatacacaaaaaatatatagatagagaaaattttatttttcaagacctcagatgccattttggaatctatttttaccacttaatgtgattatttgccccatgtcactaaatatcattaaaaattaacattagcaaaagatacctcccacaaattgagtacttaccgtttgccaagcacgacattagcactttgcagaagttatttcatcctcacaaacagcctgtgaggaagatatcgtcacacccactacactgatatgcaaactacctatcaatatctaatgatattttggatcacaaactaaataatcatgacagtatatttttttaattatgaagtcaaatttataaaagtattttcaggcagaaactagtgatgtaggaactctctctccaaatctagaagtatatatctatgaaaaaaaatatttgggggcataaaaactacgttaaaataaatgtagaaacatgttgaagatcttcgatgtgactaaaaaggaaagcctcattttttactatgatataggagtagcaaagggtaattaaaacaaccagcagcagcactgtgagctttcacagaaagatacaagttcacaaaatccctttcctaatgaccaagctccatggattggggctttcgcatctgtgaccatctttctgaatgtcctggcataccccgtcttttgtattttcctaagaggaagaaatccctctgtgaatggaacaataacctcagtgccatgtgtgtaagactatatatgcctactgcttggttgaaggccactgggaattacacacacctgttagtggggagcaacatggtcctccaatctggttacattacgtagaagtaaattataggtgacccttaatctctgttttgtgcgtccccacttaccctgccgttcgtaagtacacgcacattccagacacatgaagaggagctttttatccaagactttgaaagaaccgactaggagtttacaggaagatctctaatgagtaatagtggtaggtaaaattcacgctgagccagttctttcttggtcgtcatttgtgtacgtttccttactaaagtaccaaaatgtctttgtttcaaggtcatttcacctatggagtaaatgcataatttgtaactacgctgcaaaatttgtggttacactgactccaagttatcttatttcatactgaaaagaaccctgaaatgaaagtaccaccattcactatattgaggaggcaaatttaaaaccaggaagctgatattacctgttactgccaggtcactccttttcggattatcactggagctttcaaatcttcaagagatcagaaagcattccagtggctcaacaaaggcactgaaacaaggacaaaaaatgcctcactgacattttaggggctaatgcctatatttctttctttctttgttttttcccccttgagatagagtctcactctgtcgtccagcctggagtgcagtggcgccatctcagctcaccacaacctccacctcctgggttcaaacggttctcctgcctctgcctcccaagtagccgagaccacaggcacatgccagcatgtccagctaatttttatgtttttagtagagatgaggtttcaccatgctggccaggctggtctgcaactcctggcctcaagtgatcctcccgcctcgggcccccagggtgctgggactacaggcgtgaacttacgcgccccaccttctttctctttactatctttgatgttcatgtatctattcattcagtcaacaagcagaaaatgcctatcatgtgcaaggcactatggaaggcactgaagaatcacacataatagagacacactctcaaggcttttataacttagctgaggaacccaatttattcaccaccatgaactatatcatataataagtgctacaatgtgtaagcgctgtgggagcaccatggaggtgttacttgagtcataccatgaagtaccttttcttcagggaaggaaggaatgatgtgataatccattagaggtatggcacaggcacaaaaacaataaacccttatggaaaagtcttcactaaaagactattgaggccaggcatggtggctcacgcctgtaatcccagcactttgggaggccgaggcaggctgaggtcacgagttcaagaccagcctggccaacccggtgaaaccccgcctctactaaaaatacaaaaatcagctgggcgtggtgacgcacacctgtaatcccagctactcgggaggctgaggcaggaaattgcttgaacctgggaggcagaggtcgcaatgagccaagatcccaccactgcactccaggctgggctataagagcgaaaccccttctcaaaaaaaaataaaataataaaaaaagactactgaaaagagaaaacaaagtaaaagtagttacacagaaaataagaaaatgaaagaatctaatgataaagaaatatactgatgtgaaattggagaccagttggaggttaagtttaaaaatatatatatattttgaacacagtattgaaataggccagaggtttatgaataagtgaagcagacccattaacgcaaacactggtactgcttcctcaaagcttttgtgaaatgaaggaaggcaaaaagggaatggatagatgatcttgggagccagactctggtaagaatctgtgccctgggaaggacggttagttcttccacactgtgcactccacctcagggcatcttatctcccttccagaattcttgcctagcaacttcccttacagtgcaccaggctcccaacttcagattttatgctctactgtatttaaattcttcttatttaaatttaaaaatgtatggtagctcttcctattttggattttgtatattccttccagttgtttttgttttgttttactctcttatgtatttgcattaagtaacattttggttcacatatatacatgcctaagaaattttcctcaacctcctcttaccaatcagtaacactggtttcaccaaggagtaagattctaatgtgttaaaccctatttaatatctttcagtttgatcctcaaactgtacatttctccatctgcaagtacagcgttacattcaccaacttacctaatggaatttgatacatggttggacattactataaattagctgaatctcaatttatttaggaagctctacaatgtaactcctcaaaaggcaacagtctcctatagaatcaatatacatgtaacaccattaagaagcagcctctcagaaaagcgattcagcaattgagattaatgtaatgaaagttattcaggtagataacaatctaattttaaaacacttgaaagaaataagtcctaactcctttcccatacaaatagagatgctagccagtctggggcaagggagggttgggctggtgtagtggcagggaagatgggcacaggaacctaacaccaattttttcacttgtacatttcctaaaagaattttgaaaaaccttgtgctcttctgacattttaggttgacatgttaatttaatgatggcatggatatagtttccagtatggtatatacgtatcttaaatattattgttgcaaccctgcagctgtagatttcactcttttacttaatgaaatatgtccaccaaacaatctaattgttaagcctgttctgtcaaatcaataaatcaaataaaacttactttctgtcaaaaaattcatatttcatttcaaataaaagtgctaatctgccttccctataaaccctccctcaccacccatcaccaccacagacagacaacaatcaacttgattctaaaagaaagaaataaggtatggagtcctgccatgggtttgttacctggaggaaacatctatgattttgaccaaagcagtcatcactttgctatcttcaaattcacacccagaacctaagaattttttttttttttttggagacagagtctcgttctgtcacccaggctagagtgcaggtgcttgatctccgctcactgaaacctccgcctcccaggttcaagcaattttctgcctcagcctcccaagtagttgggattacaggcatgtgccaccacgcctggctaatttttgtatttttggtagagacggggtttcaccatgttggccagactggtctcaaactcctgaccttgtgatccacccgcctcggcctcccaaagtgctgggattacaggcatgagccatcgcgcccagccccagaacctaagaattcttaaatggtccctttagtgggtgaaccagaggatttacactccctgaagcaatcaaatattgtaagatttgtgctgggtcagaagcatgactgactgcctttgtcaagtgggaggaaagcaatttgtgaatggagaggtaggaaggaagactcactctgccacaggtgctctcaggcaaccatattagaaattatcaaatgcagacattgagcatctaaataccattaaaactatttttgcatgcaaaattcctgaaaagtctccatgaatcccgaagtgtatatatacacccactttaaagacaactaatctaaaaaacagctccagagtgcttaactcaacattggaagccaggcacacaaaacgcaaaagctgtcagtcataatgttctaagaatagaagcagaataaagataacaaggcaatgtggtaaaagctttaggatacgcaaatttgacataggggtgcagagcttggattctggaatcagaaagtctggggtttggattccacctgtactacttactagccatgtgactttaaataaatttctttatctccttggggctttgttccctcctctttaagacaggagcactattgatgttgatgatggcagtgatgatgttttaagtatctgtacttcactgaattgttgtgaggattaaatgaaataacacaaggcacttagcacaaaacgtagcatgtagtaaacattcaataaatgctaacacaacattaggagggagagttttacttaataaaatatgtccaccaaacaatctaattgctaagcctgtccttactgtcaaattaataaatcaaataaaaccctctcctgagtgtaaatcactgcccatttttgccagcagtttagactatgagtgaaaagaaggtttttaggaacaccaagccaactcaggcaaaatggagacatattttcaactacaggcctgtcctatgtccctaaaattgccttccatgaatgtaaccccaatcagagtatagtttaaggtagaacataagaatttgtccttcttactattgacccaagggataaacagcactagtaaaattctgcttttttatagatactctcaaatctgtatctgaatttctaaatgcatttaagatgcccggggtctaaaaacatacaacacagttaacaacaaagaaaacgaacttaggagggctgagttagaaaacccctacagctgttaagacagtcttttgcaaaccaagagattaggaatttaatttgtacaagtatggaggggacttccagccacttgtctgagagagcttagtacagataagaaattaatgtgcctgaatgacttagacttaattcttataaacactctcacttctgaaatgggaccggagctttgcctttgagtggacatccaaaaaggaaaaaaaaaacaaaaaaaaaacctgggaataagagaattaacttaaaaactcataaaaagcaaggcattactgtacatctgataagactgaaaaccatatgaatgcataactaatgaatttcccacacaccaagttcatgcaaaatcacacagttaattccatttcatacttttaaaccttcactagaattggttgtttttttaatctttactttcccatctactaaggtaagtcagaagaccctggatgtaaacatatcaattgcctctaaaataaagaccaagtattgaaatagtgaagaggatactgcattgtctcctagtgcttttgaggaagcagagcccaaaatcatggctcattttactactggccaaactgtgaagcagaatatatcactacatgtagcaaataacaagtaagcagagaatcaaagacatcacaatgatatatccataaaaaaagtattatcatatttgtcctaaagacaactctagaaataattctatttatctagtaagaaaaggcatgaccatttactatatataaaaacataatctttcaaagaatgtcaaaaatgaaaccactatattatccaataaattctgtgaccggggagagaaaacctactaatctctaataaatggaacctccacatcagagatattagaggtgctgtttttctaaacccatttaatgtagctctttgagcttgcaacaggatctccatgacaggtttcatttctaaaattcaattaaaacttatctacgatttaaataggtaccatatggggatgaattttaggaacctatgtaacttgaggcatctgatgacactgttaaaaggagttgtctattactgcaggaacacggtaatttagaaatggcatcctaggccgggcgctgtggctcacgcctgtaatcccagcactttgggaggctgaggtgggcagatcacaaggtcgggagatcgacaccatcctggctaacatgatgaaaccccgtctctactaaagatacaaaaaattagccagtcatgctagcacatgcctgtaatcccagctagtcaggaggctgaggcaggagaatcgcttgaacccgggaggcgaaggttgcagtgagccgagatcgtgccactgcactccagcctcggtgacagagccagactccgtctccaaaaaaaaaaaaaaaaaatggcatcctatctaatttaatcacaccataacttagagcaagttttatattttaaactatatagctttcaagtagcaatctcaaatcctataaatgaagactgcattaaaatgttaaatgtattgttataacatttccttcggaaaccagatttaattataggatcatctataatgtcttgcctttatcagaggaattggggaggtaattaagtaagtagagtgtatcactttacatttctggtcccaataactttcggaacactgtgtaacaaaatgtgctatgagaaaagagtacttgtaaaattattaccgtaatacaaataatcaacttcttcaagacagaaaaattcttggctataaaattcagaggaaaattccaaacttatgacaagatgaaaatactgaaatatatttgacatttgaaaacaaaatttccagaagtttctctcacaaatacacgagacagaaactgactgattcagaggccacgcacctgaagttgtctcaccagtcttaaaagattatctcaatacaagaaatgattgtctttccaatatttctttttcagtcttatagtctacagaagtatccacataaggagagctagcaggacacacacaccataaatcacagtaggcaggtcagctctatgcttagtcagttcttcattctacaccttctcccagttagaagcagccccatctcctctggggaattaattgccatgtaatcatcacttggattactgagctctactgtttcacttccagctttttaagagaattgctttcctcccacttttttcaaatagaagaggtgaggagatcaaaatacaacaagcactaatatacccttccccagattcaacatttgttaacaactttccacgtctgcttcctctctacatatgtgtatctgtacgttcttttgctcatccatttgaaaataagttgcatacattttaactcatccctaagacctttggcatatgattcctattaagaataacataatcaaattagccaggcgtggtggcgcatgcctgtaatgccaactactcgggaggctgaggcaggagaattgcttgaacccggaaggcagaggcggcattgagccaagatcgcgccattgcactccagctagggaaacagagcgagactccgtctcaaaaaaaaataataacataatctcttacatgatcacaatacatgatgctgaagccactattctggagaccacgctttgagaaccaacgcacagagactaagataaaactgctgttcaataaatgctcttctcctcatcctctactcttccctttccaaaagtcaactgtcattatcctatgaaaacagaactttgaatatgttatacaatcaatttgttggcagggaatacccatccccaacatatctactgagagactaaataaacaaatggtcaaaggccagatcgtaggtaactacgacccacgacctgcagctacaagcccaggcaaccaacctattatctacaataaccagtctaggaagtcagactggttactgtctagcaactagcccaggaagcccaacaatgcccttaagaatttgtacaaagccacactatctgtgatcatgcctggggaacacagcaagatctcatctcttttttttaaaaaaaaaaaaaaaaaaaaaaaaggacaaaatggccaggaaatgattagtaactgtcagcttccctaatttttgctcctgcttccaatgtaggaccaaccagagaaagccaaaaatgtacccttaactaatcacacaggttgctatgcttttagttggctcacctacagcttcccacaggaacagcctacaaacagggcatacctgaaaccttcccttttttccactctaaagtttaccctgctgggcacagtggctcacacttgtaatcccaacactttgggaagacaaggcaggaagatcacttgagcccaggacttcaagatgagcctgggaaacatagtgagacccagtgtctacaaaaaataaaaataaattagctggacatggtagcacatgcctgtagttccagctactcaggggggactgagatgggagagtcacttgagcctgggaggtcgagactgcaatgagccatgatcacgcccctgcactccacgtggtcaacagagcaagagcctatctccagaaaaaaaataaaataaacaaaagttttcccattcctctgtcttccttgaatctccaccaaattgaatagatggtggtggattcccttactatataaagaaagctctgaataagtagcctttgattgtactcatttgggtagacctcatttatttccacaaccagaataaaatcaattagttatttttgtgatgtttttgctctttaacttagaattccttcttctgagacagtgtgatatggggcaggagggacctgctttggagccaggaagacctgggtttggaaatctgacttctccagcgattaccttatgcaagttctataatctctttgaacgtgagacctgtgtttggaaatctgacttctccagcgattacctgatgcaagttctagaatctctttgaacgcccatttcctcactgatgttctccatgaagggaacaataagcacccactgcttagggctgccctaagaagagaaaataaacacaaaaggacaccgtgcctgacacagagaagtgtcaatgaagtcaggtgctctgactgggctatgttcttcagctttgaaacctttaatcctgtgagtatgaacctgctgacgttaggtgtggaaaggttttttttgtttgtttttaagtaatgttattgggagtatagagccaagtccctcactttagaaactaaaagatgagtgttgcagcttcggcataccgttttgactactgtgacagaaaatgacccaaactagttcatgtaaaatctcatcaacaggccgggcatggtggctcacacctattatcccagcactttgggaggccgaggtgggcagatcacctgaggtcgggagttcgagaccagcctgaccaacatggagcaaccccatctctgctaaaaatacaaaattagccgggcgtggcggcacatgcctgtaatcccagctactcaggaggctgaggcaggagaatggcttgaacgcctccgggaggcggaggttgaggtgagccgacatcgcaccattgcactccagcctgggcaacaaaagcgaaactctatctcaaaaaaaaaaaactcatcaacagaactatagggacatcccagactcccaaagactgagtttcaactgataaataactcaataaatcaggctgctctctcaggaaatgcttgatttgatcacctccgttgttcttctctcaacctgcttcttttgcttactcagctgcacacggccctgaaaaatgcccaccccaagatggcagtgatctataatttcataaagatttgggttacacaggtgtatgcatttgtcggaattcatcgaatggtatacttaagacataggcattccactgcacttaatggatctagtctcatttctgtctccctcactaaactgtgacatctcaaggacaaaaaggaatcatattcgacactgaatcctccacgctggcacaatgcctagcatgtaactgaatctcagtaaatgcgtgattattaaacaaaggaagcaaactgaagaatttgagaaagtctacttattgggatttattctgaaagatgtactacaagttcacattttaattaatgattacattccagtgaattaatataaacgtatttaaattttaatcattatgaagtgaactatatttataagcaaacaattagtgacttaattaaggtgccaactgttcagtgtacatgactctaccaccacctagtgtaaataaatgcatattaccacatttggaaattccctaaagacaaagaatctcccaatggtgggtcacaaactaacatacttcaaccacaaacattcagcaggtgcctgccggtcctggaaattatgccaggctccagaaggacagacacagctcttgtctgtgttgatcactgctgtctcctcagggtttaggagaatggcaaagcactttgctggccttcaataaatatctgttagctgactgacaagattctgggattaaaaggtgactaagttatcttcgggaaagacattcagccattcaaaaccaacagcattttataaacaatgaaatattattctgcactaaaaataaatgagctatcaagctctgaaaagacacggaggaaacttaagtgaatattactaagcgaaagaagccaatgtgaaaaggctacacactatacgattccaactgtatgacatttaggaaaaggcaaaactatagagacagtaaaaggatcagtgatgaccaggagctggggagggaagggatgaatatgtagggcacaggggattcagggggcagggaaattactctatgatatgatgatggtggatacatgtcattacacatatgtcaaaacccataggatttacaacaccaagggtgaacgctaatgtaaactattcactttgggtgataatgtcatgagtagaaggtgatcggttgcaacaaacgtgccattctggcggggggtgtccattgtaggggaggctgtgcatgtgtagaggaagagggtctatgcgaactctctgtgctacgcactcaattttgctatgtagttaaaactactctaaaaagtagttttttttagtcaataaaatttttttactttaactttagatatcaaataagcaaaacccaaatctaacaagtacatcaaaaatatactgtttttttaaatgcctacataaatgctcaataaatgttatttcctcacctccgtagcacaaccgcaactgcttaccccaagtagctgacatgaagtggctgtaaagaagccactgtttcttcatctgtgaaattaagacagcaggactaaatctctcacttcctattctaatttaacattcttttaaattttaaaagaatagatcactaaacctaaacttttctaaaatatagaaaaaggaaggaaactgtcaaatacttacagcatcacacagtgacaccaaaacctgacaacgaacacattaaaaattactgtcaaatctcacttgcgggccaggggcggtggctcacacctgtaattctagcactttgggaggccaagatgggtggatgacttgaggctaggagttcgagaccagcttggccaacatggcagaaccttgtctctcctaaaaatacaaaaattatgggtggtgttgtgcacctgtactaccagctactggggaggctgaggcacgagaatcgtttgaactcgtttgggaggtggaagttgcagtggacagagttcgcacctccagcctgggccacaaaccaagactccgtttcaaaaaagaaacggaaaaaaaagactcatttataaatattggtgcaaaaactttaaaagtaatagcaatgagaactcataaatgcactaaatgaaggataggctataggcacaactgtttactccagtgattccaggagagttcactattaggaactctactcatacaagcaaccatataagtaggtcaaaaaagaaaagttatatgaccatctaagtagatgccaaatagacatgatgaaatttttaaaccgttcctgattttaacgcttagcaaaatagcaatagatgactatttccttaacataatggaaaaatacatttcatatcagtctataactttctaatgttttactggaaacattactgaaacactaaaacaatgacacacacaagcatttctgttgaagtctgggaggaataaagaaagcccaccattgggcttctagattaatattcatctagaagtaccatactagccaatgcaagggaaaaaaaatcttatgtgagttttatttatttaccacacatttttacagtgcttactatatgtcagatactgttctgaacactttacaaatactaaatcatttaattcatataatcgtcataataataaggcagtactattattatctcattttacagagggagagagcaaggcacagagaacataagtagcttgcgcaaagtcacatagctagcaagttagtagaaacaggcttaacacacaagcagtcatagttccagagccggtgcttctcaccactatgctatatgaaacacgatatcggactgaaggaggcggaagtatccatatatgcagatgatatgacacatttgcaaaattcaagggagaaaaaagttgaaacattgttataagtgagaatttagtacagtggtggattacaaaatcacataaaactacgatgcttctatatgtaaacaataaaaacttagaaaatatactataaaaagatgctatttacactactgacaaaaaaggtaaaataactagaaataaaaataagtagatagttcctatttgaataaaaaattacaaccctgctggtttatcagtgaacataaactccaaatttaccaaaagcgaggtattcaaaaggtatgaactgacttaaaatgctcctcaggcacctaagtaaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagattctctgtaggaaatagtttaatgggataggtgtgcatccataaagaaactgctatgcattgaggtggggaaaaatgctttaaccgtcaccattagcaccataatcagtcagtcagtcaagcaaccaggcaaccattacttatggagttgctactatgggcacaactctgcagcagtcaaaataaaatgtgaggtatgattccatcaagagaaatatttattatatgcttggagaaacaaacatgaagagaatacaaagcaatacatgaaaagaaatacataaggcaaactaataatgggagaatttctctctgagttcccatatatattacaggaataaaaatctaaggagcaatcaatcagaatagaattttatttcttccaacttttagaagctgaaaagatttggaggactataaaatgtacacaggcaaataatccacggcagtagtaataactgatgagggattattaaaaacacactaaagcctcaaacgtcagcaatgtttatcatcctatttcattaaaacatattcactaattaatttcagtaaccagagttaatttaacaagtcactgtgctaggcttttactgaatgagtcaaaaggaaacacataaaaatactcaaagatttcttatataaagcaacaggactggatgcaagctctaagggcagctgtttaacaatgaaaaaactgggactgaaatcaagtttgtgactgaaaataggcacattgagctctgtagtcacctctatttatagtactgtaataaaagccacatattgggttaaatcaatgtcctcccatcccttagataacccactctacaatacaacaaatttataactgaagatgtagggtgataattcacattaattcagcaaatatttactgagttatgatgctgtgctcagtgcctgaaatgctaaatttaataagacatagacccagcattttttgtttgtttttttaaataaagacacagtcaagtccaagtccctgatctgaaagagctcatgttatagagaatttctcactttgtagggagagaaaaagtattcctttaaaaataaagttccttgaaacagtcctgttttccaatcattaactacctaaccaggaagatagagaattggaaaaccaccacatttgcttataagaactgaatggaatatgaattggaaataaaaatgaaatatctctaaaaccgtcatgctatactggattgaatgtacatcaagaaattgtatttccagtcctacattgagaaattttatttacacaaaatctattacacaaagcaagatataaccagctaatatttcattgagctattaccaaatgttaagaggtttcctagaaagaaatgagttctattaaaagctttagggacactgagcctccaaatgctatagaaaagccagatactatagaaaagccagatactgccttgaggcaaaaatgctagaaagtgatagaatgcgttctttacaatttgcagctaggttattacccatgataaattgataaccattcattaactttgagagcaatagacaactggcaggctatttcatgcctcaaagaatttatggcaaaaatgacaggtgactttgaattctgaaaaggattcttggaaattattactttcatgcattcctttaaataaacttggaggcagatataggtatttgctgctgatatgaattaaaggtcatgattttctacatcaatgataaaagaattaatgtttatcggttgcatcagtctgtcaatcaacaacagatacgtgaatcaggcacttaaagtatatcctgatagctgatatccactctgagtcatagcagggaaaaactatgcaaaaatacatcaataacctatattaaaacagtacaattaagagtaggaattatgtttgcaggttctttgctggccacctccttggtacctaccacaatgttggtaatcccaaaggaatttgtctctggcccaattttcttctcattctccctgtttctaagctgatatatatctaagccttcagctatcacctatctctaccttctccaggaatatctctctcttgagttgctccgattgtcaaccctggcttcacattagcattacctcagtcgattttaagacataccaaactgtgtccctgtgtcatataaattaaatcagtatctctacgaataggaccaaggcatgaatttgttgtttagtttccctaataggcacacaaggtcgagacccactgcttttctagatccatcactccagccatctcctggactggtcagctccacctgaatatctcacaggcacctcaaatttcccatgtaacatacctactcatccaccaacaccaagctaaagcattttctcctctgccctaactgaccccaggagcattaggcagtccttccacctagcttccacagtattctgtctatgcctctgttgaagcatttagcaccatttattataacttatattttccccataagactgtttctttgtcctgctttgttttaatatgcgaagaacccacaaatgagtgggaccagaaggtgagtgatagccaaaatccaaagagaaatcaaatatctataatcaggtctaaggagtcattgcaaggttggaaaactggagacatggctaaggtatcattaagcaggcagacacaagatcaaagttatgaaggaggacacaaggggatgggaatggtgtacccagggcttagctttattaaattccacctagtacaccgaatggaccagactaatccaaatctggctctaggttaaagaaaatggtcctgtaaagtctacttccccaaagaatatcgaatttaagttctcctttgtgctttcacttctacagccttatatggagccttccatctcttgagtagactttttttccttttcttgtatagacttttaaaacagcatcttaattcatgtccatactgatcatctctggccacttcaggctaacactgaccacagagttatatttcagaagaataaatctttcgagaggtgaatgttcaagggtaagaatagagaaaaaataaaaacataaaataaaataataaatcttctccctcatcactcctctattggaaactctcaggtgactcttagaaaataaggtccatgaggtcaggagttccagaccagcctggccaacatggtgaaaccccgtctctattaaaaatacaaaaaattagccagccatgatggcaggcacctgtaatcccagctaatcgggaggctgaggcaggagaatcacttgcacctgggatgcggagggtgcagtgagctgagatcgtgccactgcactccagcctgagcaacagagcgagactctgcctcaaaaaaaaaaaaaaaagaaaagaaaagaaaagaaaagaaaagaaaaagaaaaagaaaagaaggtccaaattctctaccatggcctatacagcctttctcaacttggctgtaaccaatacctccaaccattctcccacataatcaatactacattcacaatcaatattctccatctgttcacaacttagtgcttttatacaagctgtgcgtacagcagaagtacccaatccactgcctacctactatccaaaatttacagatcctgcagaaatagctcaaatgctacctcttcagtaaggctatttataactacaccagaataaatggacatcctcattcactactgattctttccaaaagtttttctggaggccctactatgtgacagtcactagcataaactttcctatagtattttgttcaaacttgagttatgacagttatgatgttatatttaaaacgtatgtgattttatcacctgcatctgtctgttcatttcctgaagataacaagcattattttctggtccaactttcctgtttttctgacttgggtccaagaggggctcaggactccatgttgtgcctaataaagacttccctgatggcaggtcacagctgtgggcacccgagggtcaggctacaaggacagatattaaaataatgactgagcccacatgtagaatataaatagtgagccaagaaagtgaagaaaggtcaaaaggcaaagtattcaggtcttccatctcagatgagaaaaggagagttaaaagtgagaaacaagacaagcagagttggaaaaactgaagactaattctgaagtgatatcatcaacatagctcatctgtgcatgacttgatatactttgctggaacaaggccataaccttcaagtagaaaagtcattcttttttttttttttttttttttttttgagacagagtctcgctctgttgcccaggctggagtgcagtggtgcgatctcggctcactgcaacctccgcctcccaggttcacaccattctcctgcctcagtctcccaagtagctgggactacaggcgcccaccaccgcgcctggctgattttttttttttttttttttttttttgtatttttagtagagacggggtttcattatgttagccaggatggtctggatctcctgacctcgtgatccgcccgcctcagcctcccaaagtgctgggattacaggcgtgagccaccgcgcccggccggaaaagtcattctaaatacagtacattatatccatctttgtaactattctgcagcctaacctagtgccaggaacatgtgatgtgaaaatgtgctgaattaacacttttgcaagtaatgattataacatacacgcatatattctatgtgtattcatctgacccagtaggcaaaacaaagctactggaaatactgaactgtagaataggatgttgatatggttcagctctgtgtccccacccaaatctcatatccaattgtaatccccgtgtgttgaaggaggggcctgatgggggggtgactgaatcatgggggcagacttccccgtgctgttctccttacagagttctcgcaagatattgttgtttgaaaatgtgtagcacgtcccccttcactctctcctgctctgctgttctcgtgatagttctcgcgagatcttgttatttgaaagtgtgtgacacgtcccccttcactctctcctgctctgctgttctcgtgatagagtcctcaagagatcttgttatttgaaagtggctcctgctctgctgttctcatgatagagttctcgcgagatcttatttaaaagtgtgtagcacgtccccattcactctctcctgctctgctgttctcctgacagagttctcgcgagatcttgttacttgagagtttgtggcacgtcccccttcactctcttgttctgctattctcgcaataagagttctcgtgagatcttgttatttgaaagtgcgtggcacgtcccccttcactctctcctgctctgtcatggtaagatttcccttctccttcgcttccagtttcctgagacctcccagccatgcttcctgtacagcctgcggaactgtgagtcaattaaactgcttttcttcataaattacccagtctcaggtagttttttacagcagtgtgagaacagactaatacaggtatcttatctgaaaccagtgacttgaaactactaactcatggcatacagtaaatatcaaaagactaatttattctaccacctataagtcacatacagtattaaagcctggaaccaaaatgtaaaacaatcaggagctttggaaataaactgtcacgtgaactgaagattcttctgtcatttggctgcagaggaaaccattccgccacccaaaaaaaaaaaaaaaaaaaaagccacaaagaaagaagcagggatgaaaaaacacaagataacacacttaggctcttgaagtcattccactttctagtttcattcccttcccaaatcacaagacacacccctacgcttgatttctgtgagataccctgaatccttttaatatattcttctttgcttcagctaacactggtttctatttcctgcaaacaaacaaatttcataccaaccataagtaccacagtgctttacctcgactgcctttattatatccaagaacttcattgtcaaaaacatctattccttttacaactctgatttcacttcttactcctcttctcaattaccaatttattcaaatatctactgagcacctgctctagcacttagtaacagaaagatgaatatgtcatggtctctgcactcaagcacagtctagtccagttttttcaagctgtggatcttgatcaatttgtaaaatcaatttacttgtcctgagaggaactttttaatatttgaaatataagaaaattaaaatactgcatcacaagaaattaaatattattttctacagcttttgtttcagttacatgtgtgtttttactgaatagcaatatagtatgtatatctcactgtgggtcatgaacaaaggatttgaaaaataccagtaggcccctatttcctaataatgtgaacaaatgccaaggaagaagtcagtcaaaagctgtgccttagaaaatcctttagtgttttaataaaaaataatttcaattggtgttttcctagtttatgttgatttcataagtacttgaaaacagttgttggtttgcctcaagtagattaaacattccgtcttgtttatagttttaattagctaaacaaatccttttctctttgccttgaacattacaaagaaacttcaattcagcatgtcagaattattataaactcctaattagctaagtacaaatttagtacatttttaccacacttacaatgaatgctgtctgggctaaataaaccccaatcatcataagagtatctatcagctacaaggctacaagccatgacaagttagcctgaagaaaagaccatgaggcagaagacagctgtgctcaaatattattaaaggcataaaatgactctaaattgtttaaggtaacttctgaaaaatgtaagttaaagagaatgtagcaatacatcaaataagcgttgggcatcttgtaggatttcttgtattaataatctgattttgtttcaaggaaaattaattcaagcatgtttattctctagtttaaaggctgtccatctttatcagatagtggaaattatctgaaattagtggaaattagtgggaaaaaaagtggaaattagtcaacaagaatatttcctaaatacctagtacatgtagctccaggtattatgcagaacactacatatttctggaaaagtcataaaatacttccaaattatatacatgttattatgttaaaatccatagtaaaaacttagaacaattttagtgccaaaaataatcacatcataaacatgtttctatagaaaaatagaaatcatataaagcacagcaatctatttccatgtgttttcaaaaacatatacttgctacttatctatttgttttgctagagagaattaggtaactaaaggctaagaaaaaatatgtaaaaaaaaaattaaaattgagggggctgaggcaggagaatggcatgaacccgggaggctgagcttgcagtgagccaagattgcgccactgcactccagcctgggcaacagaactggactctgtctcaaaaaaaaaaaaaaaaaaattaaaattgagaaaatgtattcgcaaactttgttttctcagacacaggaaaagtaccactattagctggttttcacagagccacacacttttggcatacctgtgttcacgtattcattctcatttattctaaattaattgattgtctgcctaattctagagacataaagatgaaggtactcacagtttagaaaaggaacaaacgtataaaccaaatgtaatttaatttgcaaagtgcaacacagagtagagtacctaatccaggctagtgtggtagggagggcaaggaaggcttccacaaaagaggtgaaatctaaaacaaaggataggaggcatccaggtgaaggtttggtttctgaacacttttacgtgtgtggaggtgtggaaagcctagcattgtgagtacgggcatggcaagaagaattcgcctgctgggtacagtgcatcctcccgcggggcctgctgggtacagtgcatcctcccgcggggcctgctgggtacagtgcatcctcccgcggggcctgctgggtacagtgcatcctctcgcggggcctgctgggtatagtgaattctcccgtggatgctgcaggaccccatgcctagaggtctggagaactgtgctccacagtgatcagcggtacccccatccttggacctgcctctcccacgactccatgggggcctggcctcaagtcataggcccccgactgtgccactgtgtccactggtaattgtacacctgagcaatggaagggtcacacagaccccaccacccacaaaactgcatgtcagatcaccccatctctgggcgcatcccttgaccccgaggctcggagggcagaagaatcaccatcaggccatctggtatagctgaaacaaactcagcctggagctgagagaagggtcagaactggagggctacacaaacacactaaggattttggattttatgttgtaagaaatcaggattcagagaaatcttagatagctcactctatgagctaacaaaaaacagattagtaaataagaaatgagaattaagaaacattttaggtcgaaatgagatacatactatacaatttgctggtaaacaaagcaacaaaatacattttaattgagtagaaaaaaagaaagaaaaaaatggtaggggacagcaaaatcacatctaagaggctgtggcagggatgacatccaggtgagaaactgggggcctgaactgtgtagtaggcatggaaaggagaatgcaagaaaaacttggtgatataggaaggaaaatgaaatgaacttgctgaatgactgcaatgagattgagaaaaggaaaaagtcaaggagtggttcaagatgaggcagggagggacacataggcatgctaacaatctgaagccctgaaccgagaacagtagctaggagggtaggaggggaacaagaatgaataccaggtgacgaatcaggagactaagatagaaatttaggcaagaggttatggtatgatggtttcaactaggatgatgatagcagagatacagggatatatgtatatttgagaaacattctactgctgaaatcaacaggattgcagttattaggctaacaggtcagggagagggagagaggatgtcacaaggacaaaacagtggggtactagttactgaaataaggaaggtaggagagaagcaaatttaagaatgaagattgagaatactgttttaaacatgtggaatttccagctcctctgagatatctaagttgaaatatcaactagacagttaaatacaagagtgtggggccaggcacggtggctcacgcctgtaatcccaacactttgggaggccgaggcgggcggatcacgaggtcaggagatggagaccatcgtggctaacacggtgaaaccccatctctactaaaaatacaaaaaaaaaaaaaaaaaaaaaaacattagctgggtgttgtggcgggcgcctgtagtcccagctactcgggaagctgaggcaggagaatggcgtgaacccaggaggcggagtttgcagtgagccgagatcgcaccactgcactccagcctgggagacggcgagaccccgtctcaaaaaaaaaaaaaaaaaaaaaagagtgtggaattaaaagaaaggtctgtttagactgaaatataatttcaagaataacaattatataagtaattgcaactctgtaagacaacagaggaggcatatggacggaaaagatggcccagaaacaggtctaaaatctacactttagatgccaggcgaggatgagcctgcaaaggaagctggagtctctgtttattaacaaaggttttgagaaatttggttatgaagaagagatggtacagtagccttaagaagtgtaaggcaaacggagagggtgctctttgttttctttttgaggaaagacaatatagcatgtttaagagctgatgggaatgtgtcagtagagagagaaaaaggtttaaagatacacaagaaaaggcctggtgcagtggctcactcctgtagacccagcactttgggaggccgaggtgggcaaatcacttgagctcaggagttcaagaccaacctaggcaccatggcaaaaccccatctctactaaaaatttaaaaacttagccaggagtggtggcatgtgcctatgatcccagctactcgggaggctgaggtgggaggctcacttcagcccaggaggcggaggttgcagtgagccatgactgctccactgcactccagcctgggtgacagagacagaccctgtctcaaaaaaaggtatacaagaaagacagaaaatattcaatagcataagtttccaagaaggccaaaatacacgggatccaggacccatgtgaagggtttagcccctcctctccacgatggtgtctaggtaaactgtttgtgtgtctgtaggacagtggttgaggaaacactcttggagccacacagcatcctctaaattctcagttttctggctcactgtgttaagattagtctggacttatcaataaattgttagccactaaagtacaactggttctgtgtagtctttttttcccccatggatctgttaatgtttatttattagtactagcatcttcctttgttctctgtgttaaagcaaagaaagaagagggttttgtcatataatctgattttagcttgacttgggaaacttgagattgtcatttaatatatcttcttgctttaagaaataaattccttgtgtttacaattaattgatcacaaccagctatggatttctttgttccttcgccactcccactgctttacttgacaagaaaaaaagaaacaaagaaattccttgaaaatgaggaatacaaactgcagggataaaatataaatcaaacaaaagcatctcagctaaacctctttttttgttttccagatgctactatccttcaagatggtaattaataaaagagagaaaaatgcctaaacaccaactgatgttttcttgtcaaatctgtttcatcagacccaagggatatggcaggagatggtattctacaaaataattcggattctctttctaaagacttgaattgtttcaggaaaaataaacgaattcacaaatcagtaataatgcacttgtaggactaactatgagctgccatcactctgtaaatgaataaaacatagcggcatctacttctaaaactagtgccaaatacaccactaataactcctcgatgatgcagggaatcagtgctggtaattaacataaattaatgaaggaagttgaaaagttcagaagaagtattaaaagaacacctatcggggcggggcacggtggctcatgcctgtaatcccaacactttgggaggctgaggcaggaattgcttgtgcccaggagtaccagaccagcaccagcctggggaatatagtgagaccatatgtctacaaaaaaattaaaaatcatctggattattaaaaaataaataaataaaaaacagatgctggtaaggctgtggagaaaagagaacacttaaacacttgttttttgtttttcatttttttgaaacagagtctcactttgttgcccaagctggagtgcagtggcacaatctcagctcactgcaaccttgcctcctgggttcaagcaattctcgtgcgcctgcctactgagtagctgggattacaggcaagcaccacaacacctggctaatttttgtatttttagtagagatggggttttgccactttagccaggttggtctcaaactcctggcctcgtgtgatccacctgccttggcctcccaaagtgctgggattagaggcgtgagccactgctcctggccacttatacactgttggtgggaatgtaaattagttcaaccattgtggaaaacagtgtggtgattcctcaaagacctaaaaacagaactatcatttgaccagcaatcccattacttggtatatgcccaagagaatataaatcattctaacctaaagacacatgcacatgtatatttactgcagcactattcacaatagcaaaagctgaaatgcccatcaatggtagaatgcataaagaaaatgtacctatacaccatggaatactatgcatgcggccataaaaagaacaaaatcatgtcctcagcaggaacatggatggagctggaggccatcatccttagcaaactaacacaggaaaagaaaaccaaatactgcaggttcttgcttaaagggggagctaaatgatgagaacacatggacacataaagagggacaacagacactggggcctccttgagggtggaggttggaaggagggagaggatcaggaaatataactgttggatactagacttaatatgtggatgacaaaataatctatacaacaaacccacatcacatgagtttacctatataaaaaacctgcacacgtatccctgaacctaaaataaaaattttaaaactaaaaatgagctgggcatggtggcacatgcctatagccccagctactcaggaggctgatgggggaggatcacttgagcccgggaaatcaaggctccagtgagccatgatcatgccactgcactccagcctgggcaacagagtgaggccctgtctcaaaaagaataataatttttaaaattttttttttaaaaatgctgggcgcagtggctcacgcctgtaatcccagcactttgggaggccaaggcaggtggatcacttgaggtcaggagttcaaaatcagtctggccatcatggcaaaacctcatctctactaaaaagacaaaaaaattagccgggaatgggggcgtgtgcctgtaatcgcagctacttaggaggctgaggtaggagaatcacttgagcccaggaggtggaggttggagtgggctgagatcacatcactgcactccagccttggcgacagagtgagactccatctcaaaaaaaataaataaataaaatttaaaaataaaatacacttaccaataaaacaatggcaagttgctgtgactctattacttaggacaggagagacacatcatttgacagaattagatttcacatactttaggatgctacctgttttgcttgaactacccaacataaatataagggaaataataaaaatataagagcagaaataaatgaaatggaggctagaaaaacaatacaaaagatcaatgaaacaaagagctggttttttaaaaaacacaaaattgacaaacctttagctagacaaaaagagggaagactcgaataaagaaaatcagagatggaaaaggagctattacaatggaaatactaaggatcgtaatattatgaacaactataggtcaaccaactcaataacataaaaaaagagataaattcctaacacatacaatccaagataaaagtctcccatcaaagcaaagcccaggacctgacagcttcactgctgaactctaaaaagcaattaaagaactagtactaattcttctcaaactattccaaaaaatggaagaggagggaatacttccaaactcattcaaaaaagccagcattattctgacagcaaaaccagacagacacaataaaagaagaaaattacagacaaatatccctgattaacatagaggcaaaaatcctcaacaaaatatttgtaaaccaaattcagcagcacatcaaaaagagcactcaccagtacttgcagaggccaaggtgggcagatcgcttgagcccaggagttcacgaccagcctgggcaacatggcgaaaccccgtttctactaaaattacaaaaattaggcgggcgtggtggcacatgcctgtagtcccaactactcagaaggctgggttgggaggatcacttaagcccaggaggtggaagttgcagtgagccatgatctcaccactgcactccagcctgggcaacagaacaagactctgtcttaaaaaaaaaaaaaaaagataattcaccatgatggagtgggattcatcccagggacgcaaagatggtttaacataagtaaatcagtaaacatgatacatcacattaacagaatgaaaaacaaaaaatatatgatcatttctatagatgcagaaaaaggcatttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctccaaaaaaaggaaaaaaaattaataacaataataataacaaataaaaattaacagggctgggtgtggtggctcatgtctgtaattcaacattttgggaggctgaggtggaagggttgcttggggtcaggagtttaagaccagactagacaacaaagcaagacattaccactggaaaaactttaaaaattagccgggcatggtggtacatgcctggagtcctaggtacttaggaggctaaggcaggaggatcacctaagccaaggagttggaggctacagtgaactatgatcataccactgtactccagcctggccaacaagactgtgccttcagtcattaagcctctgtacatggtagccttttcacgctaaacccaggctactgcctacccactggcccattcagtacctccacattccatcactagagcaaaagagaacttctggatccccagcatgacaagcacatgccatgaagaactcagagttgccatatgtggccagtctccttggccactcactggagaggcctctctgctgttagccacctgctttccacaatcactctcatctatctgacacacctcccaaacagaggaggtctcaccaacgacttcttcaatcttggtcttcttccattccacaattccccttggccgaaaaaggcccaaacttattataaatcttactacctagcagtcaaggcatggtgttaatatgtcaacaaaagctaaagggattttttaaatggctgaaaccaggctgagaaggcaaagtacaacataagcctggaacattttgttggactggaacattttgtcattccagagagtaagaaagtgttcctaaaaattatggaggtagatcaaatacagaagccagcttgaaggggctcccatgagtcaaatcagtgacaatttcagcatcaaaataaataagaacaataatggaacaaataggaaccaatggaacaaataggaacccatgagtccatactaataataaatagatacataaataaatagaggagaaggtaaggctcctccttagaagaaaataaagacataaatgtggagggaaccataaataatgattcaggtaagaaccaatcaataatagatgttaactctatggaggaaaaaaaactgacgaggaatagacatttgcatggtctcaaagtgtctccccacagactggctcattagttacaaggggaaaaacagtaactactcacccaaggctgtatcttaaccaagtgattaaaacttcaccaactaggagcagatggacattgtgtgcttcctggtgtgatatcctcagaacaacacagtatcacacatacactacataaatactgtcttatgtaatactctggctggggttgaaaaattcaagtctaatcatgagaaaacatcagacaaatctaattcggtttttttattctataaaataactgacttgcattcttcaaaaatattaatatcataaaagatgagaaaaggctgaggaactactccagattaatggagactaaagagacatgacaactacatgtattaatatataatccagctggacacagtggctcatgcctgtaatcccagcactttgggaggtcgaggcgggaggatcacctgaggtcaggagttcgagactagcctggtcatcatggcaaaaccctgtctctgctaaaaatacaaaaaataattagctgggtgtagtggcacacacgtgtaatcccagctactcaggaggccgaggcaggagaatcgcttgaacgtggaaggcggaggttgcagtgcccaagatcacaccactgcattccagcctaggagacagagcaagaatctgtctaaaaataaaaaaaaattaaaaaaaaaaatatatatatatataatatatacacatacatacactatatatacacactatatatatacacacacactatacattgtgtatatatacacacactatatatatacacactatatatatagtgtatgtatgtgtatatatacagtgcatatgtgtgtatatatatagtgcatatgtatgtgcatatatatatacatacacacaaaaaaaatcctacactggatcttggactaaaggaaaaaaatgcaacaaaggacattattgcaacatcgacaaaattggaaaaatgaactagagatcaaaagtactgtgtgaatgttaagtattttggatttgactaagtgtagaatggttatataagagaatatccttgttcttaggaaatgtacactaaagtggtaaggaaagagacattaggtatgcagcctaccctcaaatagttaagaaaaataaataatatttatgtatgtgtgttgtgtgtggggggtggtgtgtatagagaggaaataaataaatatgataaagccaatagagcaaatgttaaaatttgtttacttagataaaaggcatgtaagggttgtctgtactattcttccaacttttctgtaattttaaaattattccaaaataaagctttttaaaagcagtttgaccaattttaaaagatgttttaatttttttaatttttatttatttttttagagatggggtcttgctgtcccccaggctgaagtgcggctgtatgatcatggctcactgcagcctccaactcctgggctcaagtgatcctcctgcctaagcctcctaagtagcagggactacaggcacatgccactactcccagttaattctgtttttttgtagagacagggtcttgccatgttgcccagcctggtctcaaaatcctggcctcaactgattccccatccttggcctcccaaagtgctgggattacaggtgtgagccaccatgcctggccccatattttaaaataagactgcattaacctgtcatctttaatttcaaccatataagcaaggtaacaaaataaactttccagtgaagaagatctaaaaattaatgtgatataaagcatagataaacattttatgagaggattaaaacttcaactagcacagcaattatgcactggcgctctgcttactgttccactcggatttcattttgggctcatcagggatcccctgagtaagattaaaacactttatatcttatctataaatagatcattacatttgcatagaaagaagtttgataaaaatgtagaaagactacttcttaagttaactaggctaaaaactatgcaggtaccaaatttggctcctaatctcagtggcttttaaaagctaattagcaggaagcacaacccaaatatagaaagtgaagacaatcagtccaatcttggggaacaaaaacctaaagtaggtgttacttgtgatgtattatgctctgaataagtccattaaaagcatgtaagcattcaaccaaaatatttgattttaatttttcaatgattccagatgttctttaagttgaaaaaaaacaaaaaaaaggaaaaatgaaaaccaaaggttaaataggcaacactccagcacaagccacaaggggcctcagaaaaacacacacaccacactcctacaaatccacccgcctagcacccatacagaacgtgccataggtaattatgatcatcagaggcttttgatcttgtggaagaagaaaaaaaagaaaacagaaaagtgacaggcagccctttttgcaatttaatgagtggaatatgcttctacaatagctggaagcaccttttactatgttgttttttgttgtcattgtttttcgctatacctgctagattagaattttattttgtttttaaatttttaatcaaagcaatatataccatatggttaaaatggcaaataggctgggcatagtggctcatgactgtagccccagcactttgggaggccaagacgggcagatcagttgggcacaggagtttgagaccagcctaggcaacagagtgagaccctgtccctacaaaaaacagaaaaacttagctgggcatgctggcatgcgcctgtagtcccagctactggggaggctgataggggaggatcgcttaatctcgggaggtcaaggctaccccgagccatgatcacactactgcactccagcctgggtgacagagcaagatcctgtctccaaaaaaaagtcaaacagaaaaaacaaaaagcttccttctcctgctccccaaggcaatcatatctaactatttcatttcagggagtctcccgcagttactctcaaatttcttttttttttttttttttttttgagacagagtctcactctgtcactgaagctggactgcagtggagcaatctcagctcactgcaacctgtgcctcccgggttcaagtgattctcctgctcagcctcccaagtagctgggattacaggcacatgccaccacacccagctgatttttgtatttttagtagagactgggtttcaccatgttggccaggctagtcttgaactcctgacctcaggtgatccacctgcctcggcctcccaaagtgctgggattacaggcatgagtcactgcacccggcctaatgaatctttttcattccctcatttggtaggtatcttaatgttttagtttatctttttacatggcttaggttctggcaatacgagaaactattaagttaactggttctacatcttggagataaatagcacttcagcagtttgagttcagaatatatttagagtaaacctgatttattatgttattattcattttatgttatatattttgaaattcaaaaaaaatgccttgattccttattacttttgctaagtattctgctcatctcagagaagaaagtgtttttggactagctctgtaaattaccactctaggcttgtttcagaaccatttttctaaaaacattattttataaggtcagttgcttctagctaggaatattactgattttctaataggccttgttgggtttcaaaaacactttttaatgtgctaaaattgccccccaccaccatagcagacagacaactacccagctatgcactggtgatctaaaagccatttatgacatattgttattattatgacttactgttattacagtataagagaagaggcggaacacatatgcctcaatcccttcagagtttgttttttggggcgagggggtaccactcctccatgacttaagttttaaagaggtatgctctgcccctcaggggaaagcctgcaggtgtacttgtccagcattcccatgagaccaaatgaggtttgtctttgttgccaaattttgcagcagccgattgttgccatctacccaagccacttttcaaatgctccatcactaataaagctgaaattgtaattttcaaaagataacaaaaaaatctgctaggccatttaaattcaccatacataatacctaccaaaagttattaacaatttatttttaatctaatcctataacatgcttactaatagttaacatctaaataaattaattggaacaggattcaaaatgttctaattctacatcggagtgttttcagcttttacctaaactttgaagtctgtagtcttatccctcacagataagacaggcattcagttttaaacagttcttatagaaatttagaagtgggccgggcgcggtggctcatgcctttaatgcaagcactttgcggggccaaggcgggtggatcatgagatcaggagatcgagaccatcctggctaacacggtgaaatcctgtctctaccaaaaatacaaaaaattagctgggcgtggtggcacgtgcctatagtcccagctactcaggaggctgaggcaggagaatcgcttgaacccgggaggcagaagttgcagtgggccaagattgagccactgcactccaacctggacaacagggcaagactcccctctcaaaaaaaaaaaaaaaaaaaaaagaaatgcaggagtaatgaggtttcactacttgtttttaaactgacactaaacaattattaacatcaaataaattctatgtatagaaatacaaaatataaggattgagtttttaatctctactatatataaaataggactctaacaattactgcagaggtcagcaactccaaggtttatggaaggaaaaggggagacaggagacagagggcgtggtattgtctgcaggtcattctctggctttctttccagtatctccctttctccttccctcccactttccaagaagttgctactgtatgaggaaattctgtcaagtagcaggaaggggaaggctttgagccttgtagctaggactggtaagaactaagaaaattggtcctatctgtgctatcagattaaggagggtgtcgcctctggtacttttggcaaagatggtcaaatccccaactacaacctcacagtgatttgtggcgcattaaaaagtttgtacttggtcgggcgcggtggctcacatctgtaatcccagcactttgagatgctgaggtaggtggatcacctgtggccaggagttcgtgaccaccctgaccaacatggcaaaaccccatccctatcaaacccctgtcgactaaaacacaaaaaattagccaggcatggtggcaggcgcctgtaatcccagctacttgggagactgagggagaactgcttgaacccggaagaggaggttgcagtgagccgagagcccaccactgcattccagcctgggcaacacagcgagagactgtctcagaaaaaaaaaaaaaaaaaagtttgtactttttggccggcagccatggctcacacctgtaatcacagcactttgggaggctgaggtaggtggatcatttgaggtcgggaattcgagaccagcctggccaacatggtgaaacaccacctctactaaaaatacaaaaaaaaatagccgggcatgatggcgcgtgcctgtagtcccagctactcgggaaactgaggcaagaggatcgcttgaaccagggaggcagaggttgcattgagtcgagatcacaccactgcactccagcctgagcgacagagcaagactctgtctcattgtattgcccagagtggagaccagtggcacaatctcggctcactgcaacctccacctcctaggctcaagcaatcctcccgcctcagcctcccgagtagctgagactacaggcatgcaccaacacaccaggctaatttttcatatttttggtagagacagggtttcaccattagctcaggctgatctcaaactcctgagctcaagcaattcacccaccctggccaccaaaagtgctagtattacaggcgtgagccaccacgtccagccaagtttttactttgaagcaatagctaaaatagattttattcacactcaaagcaaaggttataagctatctagattttgttattctatgacaggtaatatagaaatacagttcagaaagataatgacagtatatgatcctaaagctatttttctttcactttaccaacaaattgtaatgttcattctaatgaatatggacattttattctataattacacatcaaagtatacagtgtactctatattttaaaaatatctaggtaattctaatggagtacttcctacgaactcctctaaacattgcaaacgtaccatcatcgtcactgttttacagttaaggaaactgagatgcagaggttaaattacttgcccaatgtcacaaagttagtaagtctcagattcaggatttaaactggctccacgggccagtccaatccacgcctctatgcctctcgggctttaataggcatgcacatcacctggagatcttgttaaaatgtagattctgagttaagttggtctaagactgggcctgagattttacatttccaaaatcatttagttacactgatgctgctggtccacagactgtattttaagtaacaagactgtaaaccactttgccctgctacccaactaagcatcaagaaaggggtgatatttaactcagatcctaacaatctaagcaaagaggcaattatatctgcaattcaaatacagaaccaaggggctgctttcaacctatatgaagactttcaatttacaataaaattcaagacccaactaaaaagaacttgatttgttcaatgtccttatttttctagtctaaggacaaaagcctatttcttcctgtccccatacaaacacagagaagaaaacaactttttcttttttgcagacaagcttttccagttggcatttgactaaaaattacatgtaaaaacaaatacatcaagtaagacacaaaactcttgactattcaattatcaaatacgtcacaaaaacctgtaaaagacagcttgtctctggaacactctagctcagcaactttttaaaggagggattagagaaagaaattgttccaactagtcatgcttctctattgaaaacaacatgattcagacctgacatttaaagacatctctgatgtgaattgaaaccaattttcttctttcaatctagaccaaaattaaaatgtttaattcctattaaacttaaacctcatttctctttctcaaattcaagctatttctaaaaactttcttgcacactcccttttaaggactattcagagttttctttgtgtatgcatcctattttcccaccttataagatacttagataaatataatcaatgaatttgttaggttttaaaattaacatttagtcttactgatacctaattactataatagctttctccaacgggtaccatgatgtcagaaaaaaacacacatacatactaaaatcatctcttaacacgactatattctaacactgtttttgaaaacctagagaaactacctgagacaagtttagaagggaaatatcatttatagcacacctacctgaaagtaggtgcaggctttgcaattaggcagacctgggtttacattcacctttagtgactgtgtgacctacgggcagatttatctaaacttactatgtcatagttctttgttttacatgtagtaaattcaattacatagttacagcaatagatattatagaaccatttttataaaagggaaaattaaagctcatggaatttacacaacttattgaatcacctagtaactggaaaaatcagaatttgagtccagctctatcagactccaatgcccagggcttctcctgtgagccatatacggcctgtggagttactgactgcttaactgaggtaacaagtatttcccacactctcagaatgaatctgtaatttaaagaagcctataactctactgcagcacaaaagccacctgcgtctacactactggtactaagacaaccaactattaaatatcaactagctaggaaataaacataaaagtcagtctcagctaacccaagaaatattaatacatatgtagataagggcaaagatgactgagagaatttgcttctaaggtcctcccagtcttcatactaacaaacatctgttgaggacctactgagaacatatgtggctaggtacccagttacattttacctaacattatgacacgatcaagactaaagaccaaaacaatttaaaaaaattaactaacctaacctaaaccacaataagagtttctacaactgatgctttaaatgataggagatttcactgcatctttggacagtcacctaaaagtagaagtaaatactaaggatactctgtgtaacagagtcaggaggtgagaaagcactggtctatgcacacataagtgctcatatatgcacacctgtcctctgtcctggagctggtacataagtgctcatatatgcacacctgtcctctgtcctggagctggtacataagtgctcatatatgcacacctgtcctctgtcctggagctggtacataggtgctcatatatgcacacctgtcctctgtcctggagctggtacataagtgctcatatatgcacacctgtcctctgtcctggagctggtacataagtgctcatatatgcacacctgtcctctgtcctggagctggtacgtaagtgctcatatatgtacatctgtcctccgtcctggagctggtacgtaagtgctcatatatgcacacctgtcctccgtcctggagctggtacgtaagtgctcatatatgcacacctgtcctccatctggagctggtacgtaagtgctcatatatgtacacctgtcctccgtcctggagctggtacataagtgctcatatatgcacacctgtcctccgtcctggagctggtacataagtgctcatatatgcacacctgtcctccgtcctggagctggtacataagtgctcgtatatgtacacctgtcctccgtcctggagctggtacataagtgctcatatatgcacacctgtcctctgtcctggagctgatacataagtgctcatatatgtacacctgtcctctgtcctggagctgatacataagtgctcatatatgcacacctgtcctctgtcctggagctggtacataagtgctcatatatgtacacctgtcctctgtcctggagctggtacacaagtgctcatatatgtaaacctgtcctctgtcccggagctagtgcattaagtgctcatatagttacacctgtcctctgtcctggagctggtacaagatcatggttcatactccaggaatgagggctagaagacctggttccagatccagctctgtcactcacagctgtgtgacctgggtcaagtaacctctttaagcctcagtcactttaactgccaaatgagtataaaaatagcacttaatttacgaggttgttcatttaatacacttttgttgagattacatcttgccactggcatcctgctaggcattgtggattaggtgttaaaatgcacgtgatgtgtttggcatgtgtcaaaaagcgggatttttttttttttttttttttttgagacagggtcttgctctgccacccacgctggagtgcagtggcgcaatctcagctcattgcaacctctgcctcctagactcaagtgatcctcccacctcagcctcccaagtagctggaactacaggtgtgtgccaccacactcagctagtttttaaaatttttgtagagccaaggtctcaatatattgcccaggctggtcgtgaactcctgggctcaagcaatcctcccacctcagcctcccaaaatgctaggattacaggcttgagtcacggcacccagcccagagcagggatttttgtctgttgtggttctctgctgtatcttcagtaccaacaacagtggctggcacgtaaagtctcacattaaatatctgctgtatcttcagtaccaacaacagtggcatgtaaagtctcacattaaatatcgcaacaaatactgaaaaaattgtttagcatcaggtgggtcagaaactactcccccgacccttgtttggattcagcctgtgtatttttaggtatcactaaaagaagttcaaggatctttttttaatttctttttagtttttataacagcttcatagagctataatttgcaaacaataaaagtaacccacttaaagtgtacaatgcaaccattttacattcacagagttgtgtctgccttgttttaaagacagggtctcacaccatgttgaccatcctggcctcaagtgatcctcctgccttggcctcccaaagcgttgggattacaggagtgagccaacacacccaggctctttcattttaaaaagagaagtcgggctcctgagactccatgtgtgagtttctgtcacacgtatttaaagtacttttaattgaacattttctgtaacaaaacactaaaacatacaaagaagtaaagcataatgcactctcatgtactcatcaaccaatttccataattatcaacttttttttactatattaaaatgtttcaaataccttagaaggttagattaacaaacacctctctattcagacacatctagttcctattccgagagaaaggggaaaagatataactacattatctgacacaacggtggctcttacgtctgctcccttacaaaatgtcactgtacagcaaaaataatttttaccagcaatgagtatccatagaaaacatagtaatcaatcccccattcccttccactatgctattttgggtccttctgacaaaatgaaagtaaatctcaatgcaattatccaagttaccttttttcaaaagatcttttttttttcttttttgagacagagtcttgctctgtcacccaggctgaatggagtacagtggtgcaatctcggctcactgcaacctcagcctcccaggttcaagcgattctcctgcctcagcctctcaagcagctgggattacaggcgtgtgccaccacacccagctaattttttgtatttttagtagagacagggtatcacaatattggccaggctgatctcaaactcctggcctcaagtgatccgtccaccttggcttcccaaagtgctgggattacagccactgtgcccatccaaaagatctctttagatctcaagttctataataactaacagagaaagagcaatacacatagactatagatgtaattaatctgttccaaataccttcaatatgccatcttccttctgcagatctgtaatggttgatttcacatgtaaacatgactgggccacaagatgcccagatatgtggttaaacattattttttggtgtgtctatgagggtttttctggaaaaaaaaatagcatttgaattggtgaactgaggaaagcagattgcccttttaaatgttagtagatatcatccaacctgtgagggcccaattagaacaaaagaatggagaaagggtgaattctctctctctctctctgattacttgagctgagacatcagtcttctcttgctcttggactgagacctaaaccatcaatcctcctggttctcaggccattggactccactttcctgggtctctaacttgcagagaacggatcatgggacttctcaggctccatatatatatatatacacatacatatatacatacatacatacacatattcatatatgatcatatatataattatatatataaactcatatatgagtatatatgatcatatatgattatatatatatgaactgatatgagtatatatatgatcatatatgattatgtgtatccatagaagatatatatatatagagagagagagatcgatcgatcgatcaatactctactggtttctctggagaaccttaatacaggggttcaaaaaaattccataacttctggctgggtgtaatggctcacacttgcaatcccagcactttgggaggccaaagcaggaggatcactcgagtcctggagttcaagaccagcctgggcaacataatgagaccctttctctactaaaaataaacaaaattagccaggaatggtggtgtacacctgtagtcccagctactgggaaggctaaggtaggagggtcatttaagcccaggaggtcaagcctgcagtgagccatgatcatgccactgtacaccagcctgggcaacagagcgagaccctgtctcagaagcaaaaaaaaattccgtaacttctaacatcaaagtgatcctcagtttgccatgagaggtaaaatggtgggtcagcccagggcatataatctttacactaatggttatcacctaagggcaacatgcagaaagccacagcagtgctccttagtgataggatcctcaatgttatagatacatcctcaatgttacagatggtggtacttcttacccccatataaattgatttatcatgtgtctacatctatcacatacataagcatcatgtggcacaaagtggtattaccccagattttttttttccacagttacaatggttgacgaaagccactctgtcgcctttcctggcctacgtcagggccaagttcaaaccctctccctaactgcagattagcagtcatggtgggctctccacagctctcactcagaggtgccagtacacctccctgcacatacagcgggataaacagctaggcaatctcagtcaagtgctttcttctaaagaagggccagcccctgaactaaaagacatataattttggccaataaaactaaggtaacaagttccatatgttttataaacataagatacgataaaaaacacaaagtgctccagtttcagatacagggaaatcaaggccatatacttctcagtaggggaaacgtccaacaagatcctgggaaaccagcagttggggatagaaagaggcaaacactgctccacagacaagggcagaccaaggagcctctgattccccagagtctacagttatatgcagatctctcaaggggatgaaactagttaacccaaatttcaggtttcttctgacttagaccatatgtccttacagcaccaggttgagctcattgcccctctcttgaacctaaacaaagcccagctgcagacttagaaaggatttactgttcataacaacaaaactaattttctactgtacccagacgatctcctctaaaaatgttcctttttaagtgaccaagttaaaggtaaaggatgacttccccctcgatgatatgtatatttcaattgatgtgcctgaacattaagagttaagctgttgataagtccttgaaatcaggcattctcataaaacattcacattaattcaagcaaaacattaaagagcattacataatgagtcatactaaaatggcaatgaaaagaacaaccattaagacacccagagtatcagtttagctccagttatcatttatagcatgaaaacatgtcttgagactaacatcaaaacacttacctcagcccccagaagtatcctgttcttccccttaaatacacaacatttaccaaaagcactgttttacgcaaatacaaaaggctaatctaaaaatgaaactaaaaaaacttatttggaagaatattcactaagctatctctattgcagatgtaaagccttaaaggaccatttaagggaaagggaaggctgtataattatgtaataatgttctctgatacaattgtggctctcacataagctttcttaaaagagaagagctatgaacaattaagatggcatagcacaggaaaaaaaaatgaccagcaatgagcattcacattctttctcctctctcatcctctctgctttttgggacctttccaataaaaggagagcaaatctaaatacaatccaagtcattttgtggttaattccaaataatgttccatattttaataaatctaccattgctttttcacaattgtaacagatgccactcccaactccttagatgtgaaacctaaaaacatatcacttcaaccaaaatacctaaactattgtactagttacacctaaaaacacatcacttcaaccaaaatacctaaaccattgcactagttacacctaaaaacacatcacttcaaccaaaatacctaaaccattgtactagttacacctaaaaacacatcacttcaaccaaaatacctaaaccattgcactagttacacctaaaaacacatcacttcaaccaaaatacctaaaccattgcactagttacacctaaaaacacatcacttcaaccaaaatacctaaaccactgcactagttacacctaaaaacacatcacttcaaccaaaatacctaaaccactgcactagttacacctaaaaacacatcacttcaaccaaaatacctaaaccactgcactagttacacctgaaaacacatcacttcaaccaaaatacctaaaccactgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctaaaaacacatcacttcaaccaaaatacctaaaccattgcactagttacacctaaaaacacatcacttcaaccaaaatacctaaaccattgcactagttacacctgaaaacacatcacttcaaccaaaatacctaaaccattgtactagttacacctgaaaacacatcacttcaaccaaaatacctaaactactgcactagttacacctgaaaacacatcacttcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatgacttcaaccaaaatacctaaactattgcactagttacacctgaaaagacatcacctcaaccaaaatacctaaactattgcactagttacacctgaaaacacatcacttcaaccaaaatacctaaactactgcactagttacacctgaaaacatatcacttcaaccaaaatacctaaactattgcactagttacacactaccagagttttatagataaaatcctgtctgtacatttttccaatttccaagataaatatcattttattatgaactcacagcatcacagaatgtataattactgttgacatgtgaaaagtttccaacaggaatgaaaagcttcattaataataaagatctagccagatgcggcggctcacacttataattccaacactttgggaggctgatgcaagaggatcacttgaggccaggtgttcaagcccagcctgggcaatacagtgagacccccccccacatctctacaaaaaaaattttttttaaatagctgggggtggtggttcgtgcctgtagtcccagctatttgggctgaggtggaaagattgcttgagcccaggagtccaaagctgtagtgggctaggatcacaccactgcagtccagcctgggcaacagagcaacactctgtctcaaaataataataaaaataataataaagatcatgggctctgagtgcagacagaattagctacataatttgagcaagatataacttctctgaacttcacttttcttatctgtaaaacaggaataatataaagagagacctcagaagattttgcaagactaaatgagataatgcacactaaagcccatggactcattcctgacagaaagcaagtattccttaagtgttgaccatcatcctcctctatactgagtaaaatgtatcattactgcttacttatcagtcacatataatatcccaggctttacgctggatgctgaacactttatcatagattatctcatttgttcttttaactaatcttataaggttgtttttattattgttgttaaccccattttaccaatgggaaaactaaggtttagctagtcagtttgcaggttcatgaaattagtaaacggcatcatcagaacctggaccagaatctatctgacaacaaagctccttaacagatatgacataagtattaacaggttcaaattcctctagaatgggtaataatagaagattccatacccaagtataggtgatattcatctaataactacctgaacttctgaccttttaggccaaaagtgaaaaattgaaaccccactccaattcttgaattgatatttaatctctaaaatatttatttcagggataagtgtgaagattataatacctcacatttatataatgctctggattaagtcatttgctcttcactaaaatcctatgacacagataggaattataaccccatttcattcattctgtagatgaagaaaatgaaaatcaaagagattaagtgatttgcccaaggtcacaaatctagcaaatggaagcagcgctcaaacctaagacttacttctccaagtacagtcctatttttcagtataccatgtagacaaacagatgaataatactaattaaaaagtgatcttcaaaaaaagtaatctcaccacccccaaaaaaactaattcactcatcatactcattctcattgatgatcaaagcaatggtatagttctccaatatacaacatttaaagaaaggagataagacttagaggagcataacactgttcaaaaaggtaggcccatggacatataaggaaagcaaaagatccactggtctccaagacaacaaaataaataaaattacccacctatactaatagaaaatatggtctagaactatactgaagaattttgtttaaataagaacagtcagaatgggtagacattgacggtacaagacacaatacctgcatccaagagcttccagaggaggtaaaaaaagtatttaataattactggttcaaatagttgaaatatggttgggcatggtagctcacgcctgtaatcccagcactctgggaggccaagcgagtggatcacttgaagccaggagtttgaaaccagcctggccaatatagccaaaccccatctctacttaaaatacaaaaattagccaggcatggtggtgcgcacctgtaatcccagctactcgtcccagctactcaggaggctaaggcaagagaatcacttgaacccaggaggtggaggttgcagtgagccgagattgcaccactgcactccagcctgggcaacagagcaagactctgtctggaaaaaaaaaaagttaaaatacaaggtggtaaatgtgataaaagatacaatgttctgagtacctgaaagagtgagcaccaccctaaacaaccaggagacaatcaaagaatgtgttcatctatagaaagaaaatgtaaaaaaacagaagtctcaaaatacaagaaaaatagttacaagcaatttcaccctactgcagaaaaccatgcccagtgtctaacttaggctccactcagatcttttttttttttttttgagatggagtttcactcttgttgcccaggctggagtgcaatgacgcgacctcagctcaccacaacctctgcctcctgggttcaagtgattctcctgcttcagcctccccagtagctgggattacaggcatgcaccaccaagcccggctaattttgtatttttagtagagacagggttcctccatgtttgtcaggctggtctcgaactcccaacctcaggtgatctgcatgcctcagcctcccaaagtgctgggattacaggtgtgagccaccacgcctggccctcccttttagcatttcctatgcatggtggccacatgaatcatgtgacctcgtaataaactgatcttccacaagtgcctcattcattaaatcctgctcattaaaagttgggctccaaactacaattaaatccatgtatttgatctgtgaccgaaaaattattatattaaaggtagttattacacaggtaatttcattaaaaagaagtctgggcattttaaaatagacttctagaatcatctgccagcttgacttgtacatcttgactgaaactaacagaagaaaggtattactatagatctctgatacagaaaggtcaagttcaagaaattcagtcaaaaagcaaaaacagaagaaagtgaagggtgctcagaaaaagtccaagctaagcacagaaaaaaataacagagatttaggctgggcgtggtggctcatgcctgtaatcccactttgggaggccgaggcgggcagatcacctgaggtctggagttcaagaccagccctgacaacctggtgaaaccctgtctccactaaaaatacaaaattagccaggtgtggtggtgcatgcctatagtctcaggtactggggaatctgaggcaggagaatagcttgaacccaggaggcagaggttgcagtgtgccgagatcgcaccactgcactccagcttgggtgacacagtgagactccgtctcaaaagaaaaaataaaaatagagattttaagcaggctgttatttacaactgctgcaaatattcatataaaactactatggatttagccctagtgtcctcaaactttagtgccaataagaccaataaagtagacagaagacagattgcaaaaggaatgcgtctccatcctgtaggtaaacaggtatcaaaattttatgagtaccagcgtcacccagggagcttggcaagaatgtagattctgtgccttaaaacactagatattctccggagaggcactgagagccagatttttaacaagtcctctctctctctctccacctcccactccccagtcattctgagggaggtgaatggtaggtcacttctgaagaagcaatgcaggccgggcgcggtggttcacacctgtaatcccagcactgtgggaggccgaggcgggcggatcacgaggtcaagagattgagatcatcctggctaacatggtgacaccccgtctctactaaaaatacaaaaaattagccgggcgtggtggcgggcgcctgtagtcccagctactcaggaggctgaggcaggagaatggcgtgaacccgggaggcggaggctgaggttgcagtgagccgagatcatgccactgcactccagcctgggcgacagagcgagactccatctcaaaaaaaataataaaagaaaaagaagcaatgcaatatttcaggtactatcctagtacttttgtgtgtgttgtctcatttactcctcatgaagatcacgaggtagctatttccctattttatgaatgagaaaacagaagcccagggtttaagaggcagaaggttaaacaactaaggagaaagaaaaaggacagaaaggaaatttgctctattcgacagcgatttcaaagtattctaaataaagaagctgacattctaaaacatcattaaaaacaaaagtatcaatagatcagaaagcttcaatatcttgtgtcattcagagagagagagagatgtggaaggccaatattgaaagttataaataactgtttaaatatttaaaatgcaactcagctgtttgtagtaggctgtacgtaagccaaggtagaggctgaaagtacactgtatgaagttatttatgcttaaaatttgcattatttgagcttgaagtctttattttttttgagacagagtctcgctctgtcacccagtggagtgacaaaatcacagctcatagcagcctcaaccccccaggctcaagtgatcctcctgcctcagcctcccaactacctgggactagaagtacgaccaccgcaccttgctaattttttcctttttttttttttttttttttgtcaggacagggtcccgctgtgttgcctaagctggtctggagcttctgggctcaagtgatctcaccttgacctcccaaagtgctggcagtataggcgtgagccactgtgcctgacttaagtcattttcatagatgaattaaataaccacctataaacattcgctgtgacatactatttctggtgactacacagaattatagatttgatactaataattcagccagtgaccctaatcttactagcttccataatcagtagtaccaactaagagtggtaataataatcaagagaaggagtcagtttcaaaaaatactcagaaaatgtctcagatgttatctgcagacagagtgctctgataatcctgcaaatttcagtcactgagacatttattgaacatccttgtgtacttagcaatgaactagggtcttgggattcacagaaaaataagacaaggtctccgtcctcaagaaggctaagaccacagggcaaataactaataaaacctaataaccaaattaagacctaaattatataataatacctaaattccaccgaccaatcgctgagggctggactcaatggctcacacctatactcccagcactttgggaggccaaggggagaggactgcttgagcccaggagatcagtctgggcaacacagtgagactctgtttctacaaacaattaaaaaattagccaggtatagtggcaggcacctgtgttcccagctattctggaggctgaggtgggaggatcgtttgagtctgggaagtcaaggctgcagtgagccatgatcatgccactgcaccccagcctgggcaacagagtgagaccctgtctcaaattaaataaataaatggtcttttaaaaagatcaatcaatgagaactaagtagagcaaggaaagaacacgtattaagtatgagtacctgttatacacaaaatacttccacatgttttatctcttttaattctgaggataatctgaagaggcagggttcaagattaagaaaacaaagttcagagctgttaagtagtttgccccaactcacataactcataaagaggataagacaagggaaagcaccaaagtgagagtaagtatgaccggttcacaaggcactgagaccagtcagactaaaacacaggatacactgggaaataaagctggccagagttgggccagattagaaaggaccactagttatgcttgatgaaataagaatctgtcagccgggcgcggtggatcacgcctgtaatcccagcactctgggaggccgaggcaggcatattacctaaggtcaggagttcaagaccagcctggccaacatggcaaaactccgtctgtactaaaaatacaaaaaaattagctaagcatggtagcggacaccggtaattccagctagcggggaggctgaagcaggagaatcgcttgaacccaggaggtggaggtggcagtgagccgagatcgcaccattgcactccagcctcggcaacaagagcgaaacttcgtctcaaataaaaaaaaaaaaaaaagagagagaaataagaatcagtcattaaaggcatatttaaggaagactactaatatggcaacacttcatagaacagattgcagtagggaggatctgcaaacagatataatcaactaagacacagctctagagaggagctgcccctggctgataccatcggtcctctagagaggagctgcaggaactgaccgatactatcaggtaggcaggtgttgctccaagctggccaggccctcacagggaggcactggtgtccttctgttgaacatacacaatttcacagaacatggacctcagacaaggccactctgtgaccgtgatggatcaaaacgaaaacaagaccactctgtaatcatgtctgaacgcaactctgttcaactaccgatgtgctccctggctggacggcaggaactaaagctagagcctgttctaggatggtggcagtaggaatagaagaaagaaagcaatataagtgacatttccaagtaagaataaaaaaaactgttagtaggcaattcaagagaaaaagttgagactcatacatcgcttgagtggatagcatccaactgaaatattataaatctaatctataatatttaaaatctatatttttatttaatctagttaaattagtccatgtttttcagactgaataaaagatgatgacagaaaaatatttagtaggtaattagagattaaaaaataatgatgcctgcgtcccacctccaaaggctctgattcgatcagtactgagtgtagcctaggcatcaggatttttccaagctccccaggtgattccagtgtgcagctaaagctaagaaccggtatctcagagaacgccgatggctcctgactaggaggaaaaaggacaaacgatggatagggtagaaagggacccaagaaagtactggggcaaaaaggtaagcgagaaacaaaaaatggctgaaagactagacagacgattcccagacacagcaagagtcatttaaatgatgaaagagtcactatttaacaaacgatagaaaccaggcaagaaggttaacacaggtttagatgactaggaaacatgaccaacaagtaaggccactactctgcattagcaaaatcttcagctaggagactttcaatctatgatcctctgaggatgcctggataacaactacatgtaccactacaaatagatgttaactgtgtacagcctgtttctaaatatagaggtggattcctccagcccttttccttcctagtgttcccacactgccacctcgtgggtcagcactgcaaggagccggtttgaactggaagggatttctaactggccctgtaaattcacaaggcaggtacatggtaaagcctcaattcaagggtttaatccttatgttttcctctgtttaattacagtggaagacagccttaaggtacattgtttcttttgtgggtgataagaattttctaaagttgattatggtgatattagtatgtacttaatgccaccgaagggtacacttaaataaataaaagggtaaagttaatgttactttatatcactttaaataggcaaatggtatggtatatgagttatatctcaataaagctgttacaaaaaaaggaggaggtggccaggcacattggtctgtagtcctagctactgggggggaggagaggggggctgaggtaggaggatcacttgaggccaggagtttgaggccagcctggacaacatagtgagaccttgtctctctgaaaaaataaataaataaaaagaaagaggagtaggaggaggcagctgtagcaaatacataaatggtttctaaaactgcagaaaacttaaaaaggatgtcagaaatcactcaataccttcatttcaaaaaggcaaaactgagactcagattaacttacttaccctacttacccaggcagtaaaaactaggccaaaaaggggcactattaacccatttatggaggtcttctatggtctcccaatcctgagaagctttttctcttaagcttgatcctcagcaatgctatcttttgctgcctaacttactactgggagatcacactcacaccaatgacttcacagagcagtagtatcaccactattccaatagttcaaaacccagcactcacccttcaccacagagcactactgtcaccactattccaatagttccagctcaaaacccagcactcacccttcaccacagagcagtactgtcaccactattccaatagttccagctcaaaacccagcactcacccttcaccacagagcagtactgtcaccactattccaatagttctagctcaaaacccagcactcacccttcactgcttccttgccctttaatcggtcaacaacgtgggtgaactcctcaacatgtttggttccaggccctctaccagtcccctagctcaggccttcatcacttcacatctagaataacgcacattttctcctaactggaatcctcatctccagtctttccacttctctccctcatcacaaaattcacccaaatcaggactcctacacaaatcttccatgtgcacctcatactgcagcccaaaaatctctatgggctcctcaagagttgtacctagaaaataaagttcaaaatctcttaacctcagcaaggccttctgtatcacagacgctatcccaacttataatctatcatctatacaaacagcacttcgctgcagtcataatggtctactaaacaatgtatgcacatttcccaattagttattcctccatagttgttatctctaccacttatttcactggtatcatgactttttttttattcctttcccaaaggttctcaactctggctatgcattagcattacctgtgaagctttaaacaattatgggacccttaaggatgttgctcagacatctggatatttttaaattccacaggtaaatgtgtaaaataccaatgattcatagattttaagtaagtctttttgtaagatgcttaagttttcaccactaaaactgagcatccaatattagagtcaaaaactcaaaaattaaactgcccagagaaactgttacctactacccaaggtttcttgatcattggtacaacataaatctttccaattaacatctactttctaacaagacgtaaacacagcagctaaaaaatgctaacaaggattaaatttttatatactcaaattcatttgtgagaaacatctatcataaccatgccaattaaaaattcaacataattcctgtttgtcctacctatgacaattatttaaatgtaaacagaacatgctaatgtcaatgtccagtttaaaactgaacatgcagaattatttatagatattataagcagttggactaatcccagctgtggcaattttaccttagcccttggatataaaggcacagagaagcagggagtcagtgaagatggaaaagaaagataggagctgtcaacccagactgctctataataatctggggagtattaaaaatgtctatgctctgccgggcgcggtggctcacgcctgtaatcccagcactttgggaggccaaggcgggtggatcacgaggtcaggagatcgagaccatcctggctaacacggtgaaaccccatctctactaaaaatacaaaaaattagccaggcgtggtggcgggcgcctgtagtcccagctactcgggaggctgaggcaggagaatggcatgaacccgggaggcggagcttgctgtgagccgagatcatgccactgcactccagcctgggtgacagagcaagactccgtctcaaaaaaaaaaaaaaaaaaaaaaaaggtctatgctccagccacactccagacaaattaaatgagaatctctgagggcaggacccatgcaccagcatttcttaaatctccccgagtgctttcaatgtgtagccaatgtcgagaaccaacgagttacaagggaatttctcaaaggaaatctaaagatgagagctgttcaaagacaaacacaaagagggaaaaagtcccaagaactagttagttacttcagaagtaagttgctttctcttatcagtttatgaacaatttttacatattacaaatatacactttttggccatgcgagtgactcacacctgtaatcccagcactttgggaggccaaggcagggggatcacttgagctcaggagatcaagaccagcctgagtaaatggcaaaaccccatctctaccaaaaataccaaataaaaaaaaaaaattagccaggggtggtggcacgcatctgtggtcccagctactcagagggcggaggtaggcggcttaggtggcagaattgcttgaacctgggaggcgaaggctgcagtgagctcagatcatgccactgtactccagcctgggtgacagtgagacttcacctcaaaaaataataataataataataatattcctttttatgttgaaatattttcgtcagtttcttgattttttgttgttgttgttgttattgttttgatatggagtctcactctgtcgccaggctggagtgcagtggcatgatctcaactccccgtaacctctgcctcccgggttcaagcgattctcctgcctcagcctcccaagtggttgggattacaggcgcacaccaccacgcccggctaattttgtatttttagtagagatgggatttcaccatgttggccaggatggtctctatctcttgacctcgtgatctgcccgtctcagcctcccaaggtgctgggattacaggcgtgagccaccacgcctggccagtttcttgatttttttcattataagatggttcattaacataaggatgtttttaacttttatatattcaaatctgcccagtctatcaatctatcttatccccttgtggttgctcttatttatttttgctgcaaatgctataagaacaacaaaaagaggacttgcttacattataattctcaacccaagtaatgaattttaaaaatcagtattggccagatgcggtagctcatgcctgtagtcccagcactttgggaggccgatgcaggtgaattgcttgagcccaggagttcaagaccaggctgggcaacatggtgaaaccccatctctacaaaaaatataaaaattagccgggcatggtggtgcatgcctgtggtcccagctactcaaggctgaggtaggaggatgacttcagccaggaggttgaggctgcagtgagccaggagcacaccactgcactccagcctgggtgacagagtgagactctgtctcaaacaaacaaacaaaaagatcaatattagcctactgttataaatgcttttaaatgtttaaaactaaacatgaataggccgtgtataaaacagtaaactggcaacaagtaaactttaaaaaggaaacattcttgattgtactatatttaaacaactagtaatggctctgtccattttcacttttcaaatagtagaatgagatataaaacacaaggttatcccacaagtggcctttattttttctatactaacaagtaattattatgtcaaaaactaggggaaaaactcatttacacagaatcttcttgtagtaataaactgtaaggagatcaacaagcacaattttccctccagatcataccaactccaagtaaaactactagtttcaaacataggtttcgactcttattgtgaaaaacatggtcatcatcaataagccactataccatgtaaatttcattagtgagttttatatagatatttatgacaaaatttaacttgtttgcccttttttggtctaattcaaaataagagttaatggcaaatgtcagaggctaagaacagtttggaaagggggttcatgaaggagaccactcagagacagtgttttagtggctaaaaaataagttgcctttctgaaaaatatttgtatgctttttactccattgtccaccagagggagcatcacatctgattaagagataatggggaactcccagatagaaatggaaaatcatctgaaacttgatctacgaggtgctacagatggtagcatatacagttaaatgtaaaatcaaatcagagaacccccaaaagaatctcaaagtgagtgggaggacagcctcctagggagatctcatctctaaaaaaaaattttcttttaattagctgggtatgatgttgcacgcctgtggtctcagctgctcagaaaattctggaggctgaggagggaggatcacttgagcccaggaattcaaggctgcagtgacctatgatcaaaccactgcattacagcctgggtaacacagggagaccccagtctctagaggaaaaaaaaaaagaaaaggaaaaaacaagaaaaatgagcaaaagataaatacagacaaatcacaaaaagatataaatatggcctttaaacacatgaaaagatgtttaacttcacccataatgcaatttaaatgcaaattaaaactatactaagatcccacttctcacccataagcttagcaaaaattcaaaagttcaggctgcaaagctaagggaaacaagtactcacatacatcattagtgggaatgcaaaatggtacaaccccacataggtatttacaccttgacccagaaatcccattttgaggaatctaccctgaagatacaccagcaacaatataaaaatacacacatgcaaggttattcattagagcaatatgcacaattgcaaaatactggaaattgcctaaatatccacacataggaaattagaaagtacagtggatacataaaattgagcattatggagctataacgaataaggaagatctccatgaactgatagtagagtgatttccagtagacacaaagataatgaagcaagtgcaaaactaagaatggaaaataagaacacacatataggccgggcacagtggctcacgcctgtaatcccagcactttgggaggccgaggcgggtggatcacgaggtcaggagatcgagaccatcctggctaatggtgaaaccctgtctctactaaaaatacaaaaaattagccaggcgtgatggcgggtgcctgtagtcccagctactcgggaggctgaggcaggagaatagtgtgaacctgggagacggagctggcagtgagccgagatcgcaccactgcactttagcctgggcaacagagcaagactccgtctcaaaaaaaaaaaaaaaaaagaacacacatatatacttgcttatcttaaaaagaaaaaatataagatgaaccagacgctacggtctgaatgcttataccccccaggctggagtccagtggcacgatcatggctcactgcagccttgacctcctaggctcaagtgatcctcccacctcagcctcccaagtaactgtgattacaagggtgcacaccatcccacccagataattttttgtttttttttttaacaagatgaagtttccctatgttgcccaaggtggttgtgagctcctggcctcaaatgatcctcccacctcgtcctaacaaagcactgggattacaggtgtaagccaccacttgattaagccagactttagagagacatgaaaaaaatgtaaagcaatgcaattctcattaaattttcgttgttttaaaaaatacacacgggcctatagtcccagctattcgggggactgaggcaggacaatcgcttgaacccaggaggcagaggttgcagtgagccgagattgtaccactgcactccagcctgggcaacaaagcgagactctatctcaaaaaaagaaaatatagtttgattccttaaaaaattgttacaacataataaatttacatatatgtaacaattttttaagtaaccaaaccatcaaatatacacacacacacacacacacacacatatatatatttttgttattgttgttttgttgttgttgggtattttttggaggcagggtctcactgtgtcacccaggctggagtgcagtggcgcagtctcagctcactgcagcctccacctcccaggtgcaagcgattctcctgcctcagcctccaaagtagcttgattacaggcatgcaccaccacatctggctaatttttgtatttttagtagagacggggtttcgctacgttggccaggctggtctcaaactcctgggctcatgtgatctgcccacctcggcctcccaaagtgctggaattacaggtgtgagccaccacgccctgccttaaatttatgtttaaataggtattttcaaaacttagttttaatttttatgcaataaatataaatagataaaacccacataaacaaaacatcatcagcactctcaataacgttttttaaatccctatcaaatccattttgataatttgtaaaaggataaaggggtcctgagactaaaaggtctgagaaccactggtctataacaccagctgccttaaatgccagagtatgttaagagcaggggctggggctggggactgtatcgcttctgttgcctgataatgctggattctgcactaccatcaccacagacactgggccctgctgctgctgctgctccttgggaaactggttgttgctggagagtgattctctcaaccattcttctttgtgatactggcttttattcaaagtcctcagagagcatcttagattgaccgaacttaggtcactgcccgcaccctagctgcaagggaggttgagaaggtatttagcctttttggctttttcgatagaaggcagacttggtctacatcccaccaatagtcttccaatgaggaaatcggcaaacataaacagtcaaaaccacaagcattagcccattgctctaattctttctgggaaggtcagaggcaaccttgtggggaatatcacagctctatcaaagattctcagtggatcttagagatggtggtattacacacagggaagacaaatccaagtacaggaaaaaaattgatattccaactgactcctccatgacaaaaagttctaccataataacccgacacaaggtggctggctggtcctgaagatgtgttgccatttggggaatcaggaccagttactactggcagcaaactgggcactctgtaccagcagaagccacatggctatcatgaggggaagtctgtattgttgagttccaggcaccagcctctatccccgtccccatggttgctctgttcttgagccttttgagcaagcaccaggctgtctgaagaacaacttactgctatccacaaagcaggtcatcctgtctgattaagaacgccctctgctgtggcattcacatggaccaaatgttttcaccagggctcagccataaagccctttcccaaacctcgttacagaagaaaaggaagcagtagaagaaacaggaattatgactcccacttaaaaagaaaaatgtagtcacatccataaagtcctttcccaaaccacattattatcaattcttccaccttatttcaaatcctagacccattagccactgcccaggaagttgcaaatcctacttcaagccatcgttcaaggttctgctctttgaaatgattttgctagttgcttgaccttcagggcctccaaggaagagtctgtaacactgcagcaattcacttacgcctggtgctaaccatattttacaaaatcagccgtaaacccagtaacgtctttttacattattttcacagaggtaagtgcttccttgtctccactagcctcttctactctactgacccttaaaccttgggttattttagccaatgtgagaattctgcctttgctgaaactattcatgccaatgtctaacattcttagtaacttcattatttagataattcaactaacctcagcctttgggtttcctgaccaaaaatcttttcttactccctaccttggccacattctgccacaccccgtacctgttgtatcaagacacacactacttctaagcatgtacatatcaagtcaacccattatctgaccactcaccatttctctgaccacatgaggacctctaatccattgattcggccacatttcactggccatcaccttccttacgacctcattccctacctgagaaaccatgatccacaattacaccctcccttgcctacaacttcaacttcccgtcccctctctccgtccatcatgctaacctagcaatcctaggtaaatccagttctcatagccaagcagctggcaattgggagagaaaggaaacatgacccaactaactgttcccactttaaataaacaaacacaagttttaagtagaccctcagcacttttcaacaatcctacatttcacgaggcaatttatgcttctctcctagaagactatttccaatctctcctaaggctgagtcacttagcaaccacttccctagcggtccttaaacttttcaatcaccactgctgttgccttttctggcacctcttcttcttaccctcatatatgaagatgttcccttccatctccaccccaggttcagtccttggccaagagacattccatcatctcaccaaacacagtgagttattaccctttattgcctggtcacatttactcacactgcaactcaaatgcagctgcctttttttttttctttttttttgagacagggtctcactctgtcacccaggctggagtgcagtggcgtgatcaccactcactgcaacctccacctcctgggctcaattgattctcccacctcagccttctgagtagctgggactacaggcatgcacccaggtaattatttgtatttttagtagagacagggttttgccatgtcgcacaggctcatcttgaacttatgggctcaagcgatccacctgcctcgacctcccaaagtgctgggactacaggcatgagccaccatgcccagcctgctttatcttctataactcatctaatctgtctcctgaatatgcgccattttttctataattaatctaatattcctcatgaatatctactctaataaatatccaggaaatttaaaacttgtcaaacaatatctcaatctcttccagttaatactcagactttgtttaactccttacccgggctggtttaaatggctgctttcgggtagatttccctccaaggtcttatcggacatcctagaagaaatagtggcaagaagaccttggatctgtgttgtttctctggatcctcactggtctctgctgcaaggaggtaatcaggtcctatggctgaactggtcccatctcatcttttaggatgtcatgctggctctcatccctggagtctgtgatcctgacattcagtctatagtcacacagtcttttgtcatgacgccagctgttccaccaggccaataagctcctccacctccttcacagtggtatgagagcatttcagaatcccctggtaccacaaactcaactatctagccacttccttctaccactgctgtgctataggcccgtgttggcctatcactaacctgcataacatctcctctcaagattccacataaggagcagagcaaaaggccttctactgctgaccgtcccctcaacccatttaacatccccaccctaaccctagaactttagccagccaagaaagatcagaacacatatttctcacaatctgttttccctacctctgtccccccgctgcccacaatccaccaggactgaaagggatgacacgtctacttccaagtcatcctccttcctcctgggaggcactaagcctcattctcagccttaatgccagatgagctattctctttaccctacagaagaaactatcattagagtttgccagaagtaactcttgatatggaagctgcaggcaacttggaacttgagaaaaccaaagacaaacatacagcgacttcaagttccccaaaatattaatccttgaatgattaacatctcccatgtggtaggccctggggatataaaaaagattagacttagagcactacactagggagtgagaaggtttacaaatacaatcataacaatggaattttatgtgctgcactcaccaaagcaaacgggaaatacacataactcatacccaattgtcaaccaacctgttctacctccatcaaattaaaaatgcatgcaacggcagaaggacaatataagtgatttcaggccggggacagcggctcacgcctgtaatcccagcacttaaggaggctgaggcgggtagatcacctgaggtcaggagtttgagaccagcctgactaacatggtgaaaccccatctctactaaaaatacaaaaattagccaggcgtggtctgtaatccaagctattaaggaggctgaggcaggagaatcgcttgcacctgggaggcggaggttgtggtgagccaagatcacaccattgcactccagcctgggcaacaagagcaaaactccatcttaaaaaaaaaaaaaaaaaaaaaaaagtgatttcaggttataatttcattgccatttactctttctacaacttacatacttcattttcttttccaggcacaacacggaaaaaccagaagccattccttaatgagaggaaaaaggtaagataagccatgaagcaggttcacctttctccattaacaaaaacaagtatacagaactaaagctactaatcaaaacagctctagagcaaaggaaatcatgtaaaacttggtaaccattgtttctggagcctaaggaagtagagatgtgcatcccttaaggacatcatgaggtgatttcattgttgtaggaacatcatggtgtatcctcacacaaacccagactgtacatacagcctgctacacacctaggctagcaggtattgtctgtactgcctactgctctgaggctataaacctgcaccgcgtgttactgtactgaatactgtaggtaactgtaaaacaatggtaagtatttgtgtatctaaatgtacctaaacacagaaaaagtacagttaaaaaatgatataatcatacagggccactgtcatgtatctggtctttcgctgaccaaaatgtcgttatgcagtgcatgactgtaattatcatcaatatctgtttttttaattctattttgatttttcctttcccatgtaactgttaattgctacaaactaacattttcattccatacttaattcagatggaaggcagcagaaggacaggggcagttaggaggaaaattctgccagacattcatactaaaactaagggcttactatgtgttagacactggggctacaaaaactgaaagatgcactattcttaaagacttcacaatggacagtgaataaagagaaacaaattttacttacaagatgacaagtaatacagaaacttatccctcaaggacaggcattcaacagtggcagaaaactgcatcaaacaatgcgctaacatttccctaacactattttcaggttgcagtgattcccaaccaggctctttggaacactataaccactaaaatgggagtgttcaaacagagcaactactaccacaacacaagtgaactgtgtatcctggcaatccaaagtaagtgcaaatattttgtgtctgtgtaaaatactagtaagtatttgtcagtcattatgaagaatctgtttagcttgttttgtttagatgcttagcatttacttatatccctttttctatgtttatgtttgctgatttccccactggataactatcggtgggaagtagagtgagcctgccttctatcttaaaagccaaaaaggctaaataccgtctcaacctccctcgcgctaggggtgcaggcagtgacctaagtttagccaatccaagacactcactgaggactttgaataaaagccagtatcacaaagaagaatggttgagagaatcactctccagcaacagtgagtttcccaaggagcagcagcagcagcagcaccagggtccagtgtctatggtgttcgtggtacctactgcagaatccaatattatcaggcgacagaagtgatatacaccccagatcccagccccagctacttttgcagtgcaatcctaacttggttcagccgatgcccagtcaagtcttggcagactttaaagcaacactgagaactcccccaaaactctttcattaaattccttttttgcttaaatccccagttactgcaaacaggaaaaatgaatgagactaatgaaatagtatggtaaatcaacaagcatcccacccacaaagggtttgtgtagcttattttggaaatgcacaattccgtgtgtcacaagactcaacttcagctctaatgattcaattgccaatttgtcaccatttattcattccaaaacttttctgttccaagaactatcttgaaaggaacgaattgttttcaaccacacagtttacaaaaacttcaagatgctgctctctcccgaacagatgttttcgctgttatcattacttcagaaagcaacagacaaaattattatttggtagctctaaaatgcaaagtcatattcctgaattatgaatcaaatgagaacaaagtaagaacaatggtcaaattacagatacgagttttgcacttaccgtcccacctccacccacctaaatctcagactggcaggtctgaaaagcggccatgcacaaaatcatcgcactcatctcaaaatagaactcttcttcctcgcacacagaagctcaataatatttgttgactgaatgcagttcctattattcatgtatgttacacatttccataaattgctttcacatagcactttacaccggcacagcgcgtccaggcttccaaaacaccttcacgtgaatccctgcatctagaatggtggttaagagttagacatgcctgcacagccattaaatggcacagcacacgggggacccgtgtctgatgctcccacagcacattaattgcccctctatttcagcccttctggtacactgtaattctctctctcacttgatcagctctttgaggaggtcccgttcctcttcgtatccccaggccacacacaacccagaccacagaggtgcaccgtagacatcaagattcttccacctgctgcaagcctgatgctttaccggcggggcctctgcaggggagcctgatttatactcatcccagctcccacccagccccacgcccgccacgtgtgatttccacagccgcaccaaggaagactgtccagcacacagacttttcgtctcccagcaaaattatccccggcacaacgcttccccctcaagtctgcccaatggctttcccatttccaccgcagcccaggttggggggcagtggctgagcctgggccccctcccagccccgctgcggcaacctaggggggtgtccgggcggggcctgtcagcagcgacccgcccccgggcacacgcgcgtcaggggcagcaccgccaagctgcctgtgcagccccatccagcaggagtcccgcggctgccggccgcccgacgcccccccctccccagcaccccacacagctcgcgactcaggtaggcgagggcgctccttacgcacccgagaaggcagcggtcgcagacgacgccacgactccccttgcacaccgtgtacgccaagggatccgagcggaagagtagctctccggggcgcagcggggtcacggcgcgcagcccgtttcccctcttggcggttgcgaacttttccaccttcagcggctccatcctcccgcagctccggcacctcagacggctacccgcgtccagcagcgggcgtctcacgggctgccgggacccgcgcgcctgcgccctgcgcgcacacgtacgcccgaggggcggggcgggcgcggtggggcaagagcatgcgcagatggagtctggagggacggctggagtggagtgtgtgggacctgaaggtggtcgtaaggctccgcgtgcggctcgtgcccatggcgactgcgcagaagacaggcggggttttttttctccctctaacattgtattacgatcattttaacgcatacggaacagttgaaaacagtgcagtgaacacctatatacctccgcctaaatcagacaacctagcactttgccatttctgctcgtcactctctccccacctgtagctatgtatacacgtattgtcgttaaactatttcaaagttgcaggcatcatgacatcacaactagtactttgcactgtaacttttttttgttttaggacggagtcttgctctgtcgcccaggctggagtgcagtggcgagatctcggctcactgcaacctctgacctccgggttcaagcgattctcctgcctcagcctccatagtagctgggactacaggcatgtgcaatcctcccgcctgggcctcctgactagatgggactataggctcacgccaccatgcctggctaatgctttttactttcctccagagacagtctacctatgtcgcccaggctagtcgcaaactcctggcctcaagtgaacctgaacctcctgcctcgacctctcgaattgctggaattacaggtgtgagccaccacacccagcttaattttcttttttgtttttggggtttgttttgttttgttttgttttttgagacggagtctcattctcgcccaggctggaatgcagtggtacgatattggctcactgcaacctctgcctcccgggttcaagcgattctcctgcctcagcctcttgagtagctgggactacaggcgcctgccaccacgcccggctaatttttgtatttttagtagagacgaggtttcaccgtgttagccaggatggtctcgatctaaccttgtgatccgcccgcctcggcctctcaaagtgctgggattacaggcgtgagccaccgcgcccagcccacccggcctaaatttcttagtttggacaaacgtgccatggtaatgcaaaatgtcattattaagggcagctggatggaaggtgtaggagtacactatagtgcctttcaatttttctgtgtatctaaagtcatttcaaaagtaaacatttattttaaaacatgaaggtggttatgcttccatgagtgtaaagtacaaaaggcaggctcgtggtgctgtcagaagtcagaacactggtttcagggctgggggtgttgggaggggctgggcatggttggctttgtgatctgggggctggtgtgttccatctgtgaatatcttttaagctgtgcacttaccagggatgtaagtcatatcttaataaattttcataagtttgacaaaaaataaaatgaggatgggaagcttgtttgggttgtggggcctcgggtgcttatccagccatgagctgtgtcccagatgcttctagaagcctggagggagctgagaacattccaagtcgaggtggcagagccaaggccctgaggtgggagcgcaatgctgcacatccccagctgtgaatggggtgtcctggtcagaagcagtgctgtgtgcactgcagggccggcaaatccacgtccacattgtggcttggtgcagtgaaagccaatctcagccccctccacagtgtgattagcctgccagcaggtggccagctggtcctcctgggaaatggtgccaacccagagactgggtgcaagtgtctcatccacggaggggcgctcagcagtggtgtcagcctggtgagcctcggtaagggcacgtgcaggatgctgagcctcttccgttcccatgcccgtctcaaggccacttgctccgtgggcccatccagcaagcatggtggccaggaaagaagccggctccattcacagggcgtgctgttttgctcacctcaggaccaagagcatcctccatagtgattctctttggtgggagcactagaaacatgaaccacagataccttcagcgtctgagccgctgaggcgagggctgcaggacaccctgctgtcgggaaaccctgcactggcggctggaaggcatgtggtggtggcgcctgctgtggctgcagcagttgctgcgaggcttcgggatctcgccggcccctgcgaggtgaattgtgacagtgcagagctccgtggtaccagggccccctgcatggccatgctgactgcagctgggagcccaccacacctctggttccccgctcttcccagggctggggtctaggccaggcccctcttggcctgcgaattgtgccctgggagggggacactgttccacaggttgggaccaaggacccagggcatgctactggctggctgggctgcagggatgccatgctcacctttctctctcatggccttgacgggaccggcttcctcattgaacagcattttccaaggtgtctgggattgctggtggggtgccaccctggctccttctaggcatgcccgtcattggccaccaagggggccagatgcaggtgcccatgctgctgtgggggcatctcccaacttccctcttagtcctgatgggcctaggcagggcctgatatgggggtccccatgggcttccggggctaagcctgccccatggtcccagggctgtccaggacacattcagaagggacatgagctcagcagctctgtttgaaattattatggaaccaagggccccccacatccaagtccactgggagtcgggacatggagttccgctgcaggtacctccaggaaccccgaggtcctccttgagccaaggccaggctgggcacaccataagtcctgggtcccccagagaatggcctgctgccctgggctccccagaagccccctcacgcccctgggccttggccacatggaagccccaccaggacaggtgtgagaggacaaggaacccatggtggggaagcagaccaaatgggccgctggaaccaggctggtgggccagggggcacctgcccatcccccttgcagagggccttcctgccacgtgaagccagcacagccctggctgctgaggacccttgcctgggtttggctgaaagaaaaacagacgtgatcaggcagcacctccagtgggcccaaagagtcctttctgggccgggccccacctgcctgggtctccggagtcctcagggtctctcggtggcccctggggtctgacactgaggacacacctgcaggctgctgatcccagagggaggggtgtgtgtcacctggggtagggaagctgtcggggcacagcaggtggctcctgggactgccccccaggattcaggctggctgggggcttcctgccccatgccctcatcccagggctgttgggcctggtatatgatccccagtcagaactcaggtgggaggggccttggctgtcacccagcccccttgctacctcacttggggacctgtctctaccatgagtaagagggcccagatacggggccccctctgccctcctgggctgcccggtccatgccaggactgaccattcccacacctggctgaactcttggctctggctctgggccaggggtcccacctgtgcccttgccctgaaagctctgggggtcagggacaccgactcccttgtctccctggctcaaggctcgttgtcctggcacccttggagggatgttcaggagtgaggggcctctgctgctctctgaggctgtcagtgcttgcagggaggggtggggggggtcccacaaatgggtctggctcctccagtgccgtcaagggccctgttgggggggggcgggacaccgtggaaagtgggagggggcttgttggagaggtcttgcccacatccccctcctgcgtgcacagcatgtgcagtgcacatgcactgagcacctgccctgaggaccgggggcctattgtctttcttagagtccaggaggaaaaggaggaagaaaaggcacaagaggaaggcccaggtagtaggcttgggggtcccgggcgctcccccactattgactgccccagagggtgactcaggagggggcctggtatggaagcccatctgggggtggcaggtccccattcttccttgttagcttcctcgtagaggcccaagggtgcccgagagctgcgtcttcatccagggcctaggtatgggagaaccagcccccaaaactgcccatgggccagacctggatgtcttcatgaggccctctagggatagggtgggcatcaggccaggagagttccctgggagggtcagagcccatacctcattgccacctcaaccgtctcccactgggaggtgccagatccttttgtggccaccccaggggtccagatgtgcataggaggctgtggctgggggtggcctgggcagggaagtgctcaccacactccagactttcatctggaacatgtcgggggtgggcttggtgtcactgtgccctgcccagcccacccagccagacctccccctgggccagagcagaggatcatggggacagtgtgaggaagctgccctcaggccagtccgagtctgaccccagtgctccccagtgccattgggcacacgtggacttactccattaaaccttaaaggcagtgcatgccatcggcatcaacacctgttccccttctaccaaatacacatcccacaggtgcaggttgagcctgagagagatctatggggacagcagacactggaggacctggcccttcaaggctgggggctggtggctcgagctgggcccactgggacttcagtccccagagtcagtgaccctccccatgagggtcatctgacccttccaggaggctgggtcagacagggtcttgcagctcctcatgaggggcactcatttcagtgggatatggcttctggagagagggacctccccagggcttgaggcttctgagctctcccaagttgggttctgccccagtcttcccatgaggctgggcctgagccccaacctctgccgtgggatgacccttcttgggcacggggccttgcttgtgtgtcctacagggccccgtctgtgcctcctgtgggctgggggtgagccggacccctgggcacggggagcagggcactgcagggcaaagagggtccctgagccagggtctccctgggcctccttgccccatccatcaagctctggagcagccagcctaatgaggaaccctgcgcacatggcccttccttgtcgtgatgggaggaacagaagtgctcagggccccctgggctactctaaaaaccaaacctccctcttccagggtcctctgaagacccttccccaagtgcagaacacaggatggtgtccagggctccacacgacaccttccccttcccgcactcccagcggacacactgcccttagccttgctctgcaggaggtgggccccagtgcctgtgcctctgtctcctccagggcgggaaaggaaacccaactccaaacgcatggagaaccccacatcccaggtcaggccctggctgggactcagcctctcatcagtcccatgggggtctctagccagccctacgggatgcagggcctctgggaaagagccgaggggaccataaacacacagggtgcctcgtggtcttgggttatgacgtgggtaccacgtgttcctggtggtcttgtagcccctggacccttgtgctatttgggctgtagaatcctgagacgcccccagcccatcatgaaaccagagccagctcccaagatgtggagctgtcagctggaagaactgggcagctgcagaggcccccgaaccccgaggcctcccaccctcccatctgtgaccccaccatgtggccttggccctggggagaaggggtgggaacatcccctggagcctggctggaggtgctccgggaggcctcctgggccagggtgccgggagggcaggcctgactttgaggccacaacagagagtagaaagaacaaggtgggtgctgggacccctggttgtctcttggaagtggggtcaggccaggggacatgggatggggaggtgctgccatctgggctttgtcagcccacctgtgggaaccaagggcagctgaagcccagccagctggaggccaggaggactctcagggaggggagagtcagctgcatagaattcgagctggagagcgtggctccaggacatagagggcggccacggcgaggatgagatgccctctgctgatggggatgaaaggcatctgactcagggtctgggggtccccattcatccatggtctcctgtgggaccttcagcagagacatcctaaaggctcccaacaagctggtgacacaaggaaggtacctttgctgaaagtcgagatcatctggctagggtggctgtccccgggtctggctgcatgaggtcggggggcagctgttcacctaccctgtggggagtgcctctcacaagccaacagctgggccagtgcccagaatgcatcctccccaggcccataaaggagaaacaaggcagcagcgtggctcaggtccctgcggtagcccacctcctgcaagatccagagtcaccatggaaggacatctcctggagggctgaggtcacctgggaggactcatgtcatcggagagggcagaggtgactggggaggcttcctctgaagaagaggcttcctcaggatgcaaatttattttctgacaagagccatgtccatcaggcacttcagcaacttgtccaaaatgtttcctgagagcactgtcctgcatgtgacactaccaagctcctgggctttggggcagccccaggaggagggtgtcatttcttgttatgaaaagtggtggtcaggcccaggtgacactagtagttggggccctgacttctttgtctcagtttgaccccttgagaccacctcccttgcttggagatttatgccaacggtgagctggagtcctatctactatatcctgatgggtcacaaatactgactttgaaagaaacaacgatgcccctaccagacacccacgcccacgaacgtgggaatatggcccagaaacgtcactgcctgggaatactcatggggttatatgccaaatataccaggaagatgtagaataattcctgctgcctaggaaagagataaaaggggctttcgtttgttttgtgcagacgcttttagtttcactttgcctacaaaccctaacaacaaatccagtttcaggttcagatgattcaccagataagtcacaagctcttcaggaccttggttgtttaagaaatgtttcaggccaggcgcggtggctcacacctgtaatcccagcactttgggaggccaaggcaggtggatcacgaggtcaggagatcgagaccatggtgaaaccccgtctctactaaaaatacaaaaaattagccaggtgcagtggtgggcgcctgtagtcccagctacacaggaggctgaggcaggagaatggtgtgaacctgggaggtggagcttatagtgagccaagatcgtgccactgcactccagcctgggtgacagaggaagactccatctcaaaacaaaacaaaaaaaaaaagtttcagtaaaatccacatctgtgaaatgcagatatcccagttgtatagtgagttgactgatcacactctgatttttattttttcagtttgcacacccaccagttcagtctttggggtgtacagtacctccatggttctaaaccaatgtgcagagtctcctggtcaccactccagcccctcctggagcgattccttcatcctccaagtctccagggtgtcccctatgtagccaacctcttcccggtccatcagcccttggccatcccaacgtgttttctgtccctgtgatttggccttttccagaatggcctattaattggaaccctacagaggtagcttgttgggtctggtttctttcccttagcaaaatgcaactaagatccactgacgttcatgtgggcatcactggctcattcacttttctcactgagtcttttttcctttgaagggagggccacccatcctctccccattcccatgttgaaggttgtccccatggcctctgtgtgtgagtgacgatgaatcaagcagtgaatgtggcatgcatgtttcatgtgtgttaagtaaaatgtttatttagaaacagaatgcttgatccttagtaccacaaagaaacatcagcatttagacaaaaagttttctcagcaaggcaattttaccttctgcagaaagggtgctcctcacagatggaacaatggtgagagcacacctgaataaaagagggaagcaatttttatcctttatgcagcttgtccctgctactgtgtcctgtctccattggctggagctgggccatacaatctaaactaaatctgactggctaataatttaaaatgtctctaaatagctgaaagcaatggagaacaaaggaaaagaggaagctgcttatgaaaagacttagaaaagtaataacattcccaaataaggaaggggcacaggcttcaagctgggacctgcctgtgagcacgtccagcacagataaccctgattgaagtacgaggacatagaatgtacttattcctttatatctaacagctgtgtagaatagggcttaacaaagagttattagcacaaagcaaggaggcttgaaggaaattagtctttaaaggaaactgttatttctaacacttatgatttattctttaacaagaagggaaactttgaaaaggaactttttactttctacagtgtggatgtcagttttcaaatcagttggttcaatgtctgtgacacttcggggatgtgtggtttgagtccactgagctttgcgagcgactgcccaactggcttccaaagtggctgtgtcatgtcacatttccaccagctgtggatgagagtctccggggccccgaatgcccccgcccccagcattgggtgctgtcggtgtcgccagaggagtctccggggccccaggtcccccccccccccagcattgggtgctgtcggtgttgccagaggaggttcaccagccctccatcctgctgccccccacccatgggtccataccatgggtcccatgggtcagggagagcacttttcaccattgtgcatgattttgtttgctgccttctgtctcctcaggatccttctgggttctggccccacatgttctagcctggcccagagcttggaacctgggaggtcctcagtgcatggtacgggctcctccctgggccaggagagcccttggcagctccgtcatccctcctgggtgaagctggtttttgctctggggaagtctccatccctctggttcacttcatctctgctgggaccctgtggcccccataggcttacctgatgccatatcatttcctaaatattatgtgattcctcagtgtccggctcacctccaggtcaatctggtggataggttcagaggacctcttgcccttttctttcatgacctgtagggcatggccaggaggaggaagcagcctcagaacagatggaaggacccctgccccagatggcagtcagcccacagtcagcactcgtggaaggagggaaaaaaggaaggtttccttctgcagaaagctgctttttggcttgtttctgaagccagggagggtcaccagagctgagctcatttggggtgcctatgtcaccgtctgcccaggatatgcttctgaccaccccagccccaccgataagctgggctcgatgttccctccatctggagacctgggctcctgacacagcctggcctgtttgttgtgctctggctgagtatacctcatatttcccagggttctcaggcttggtttcctcaatgtttagcaggactgaccacacccagccccagaccttcaggagaatgcctttgtacactctggcagacaactgatctggtgacacaggccacagggtgacctcagcaaggaccagaccccaaggattctggaagtctctggttttggccccatgattcctcaatacaggtgaggtcaagctgggacagggtctctcctcccagggctgaaagagtgggtcagcactcagagtctgaactctgatctacacctgttccttcaccaggaggcttccctagccctgatctacggtggccccagccctggcatcagattccctcccagcaaggtgacgagcgcacgaatgggcagcaaagctggcgaccaggcctgctgtcgtctgagtaaggacagggtgctacccgctctctaagaggcagatggtgccagcccacagccaagggtgcctgtccccctgactctgcagacagtggttctgcaggcctctccctccccacattaccttcttgctcatcctatatttctgccattctcccagcatcttcagccacttttccatgtgtctcatgtcctgtcacatttgctgtcaaatgaggaatgttggagttagtggagccgccatgcttcccggagtggcccacggatgctgggtcctgggttctggagctctagtgggacccagctggaaggagctagggaagggcagaccctgggggctgagaccctctgagcaaatgagcgccagtgggctggccttgtgaccctgggacgtgccatcctcaggccacagacacaccagtcttaggtcgggtcacagcctctaggtggtatcctgacacaagcgggcagccacccccaagccacgactgttgttctcactttgaaatttcggcaaactgccagagaaacagagacttggggtcaggtccagcagggacagctgcccctcccagtgacagtatgttgctccctcccacccaccaccacccaggcccgctgcctcctctgcctcaccgaacacccactgagtccccatccctggaccagctccccaagcatcagggacaggctcttaccttcacctccagggcattgacagggggcaactctgtctcactggaaggcacctgacagagctgaggacctgcgcagggcctggagccatcccggtccaggagtccacccccagaaaggactggctctgtccccttccatcccaggtctcagctcgggagaagccacagggaagggaggacaagggccctgtggggcagactcccaggaggggcccctggtgtgggggatggtcaggctgcacaatggggctgcccctcctggactggaggtggtgttttctgctggagctcagaaacgtcagctctgagatgggactgctgctgcccagggtgggtggccacgcccggacgggagtctctcagggagtgaccgcatcaccctgctggggtttgggtgcctggcctgagacctgcctggtgcacccggggcccatcccacctgacactcccaaggtcctcgcagagtctgaccacctggagcccacctgcctctccctgcacctgagccacacaccctgctttttccctgatttccgccatcctgtccaacccaaaaactgtgaacgtctctccagccaccctgggtctgctttgactctggtcctgtcagaacccctgagtgagactccccggatctgttctcatgcctgccttgcctgctcgagagatgccaggggtggcctgggtgaccgagggccccacaggcttccaggacagcctcctggccccacctcctgcctcacctggctttcggagccattggctgtcagccctcagcctcctcccagacactgcagcagatggaactcgggacacctggccgttctccccaactatcctgcctgccccaggtcagtcccccgatcaccctctgcccactgtgctgtccaagccaactggaagcagagtccctggaaagccacgtagaatcttggggatggactgactccctctgctgagaagtcccaggtgagctggtgttttcagccccaccccatctattgtcctccccagacaatcagctccattggggtgcatttccgacgtggcacagcccatgggcttattcccatcccacctcccccagggtcctctgtctttccatcctgtgacccctgagggattggctccaggctgggctctcttatctggccccagataccgtcccagtaccagacccagggcctttagccacaagctctgctgcccgcctggccagaatgcctagaatgggggaccctgcccatcttctcccccattcccctaggcccacagccctcactgtccccatggggaagggcatggtccttgggggaaccatggcatggtccatgcggaagggcatggggacagtgagggctttggccctaggggaatggggagaagaagggcaggtgggcccctcagagacctgctggacagctgccccaaggctggaccaggtgccccctcaccctgtggccacaacccttggatctcactaggatagtgtccaagtggacagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccctagatgggccacgctccctagatgaaccacgctccctagatgggccacgctccctagatgaaccacgctccctagatgggccacgctccctagatgaaccacgctccctagatgggccacgctccctagatgaaccacattccctagatgggccacgctccctagatgaaccacgctccctagatgaaccacgctccctagatgagccacactccctagatgggccacactccctagattaaccacattccctagatgggccatgctccctagatgaaccatgctccctagatgggccacgctccctagatgaaccacgctccctagatgggccacgctccctagatgggccacgctccctagatgaaccactctccctagatgagccacgctccctagatgggccacactccccagatgggccacactccttagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccactctccctagatgagccacgctccctagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccacactgcctagatgagccacgctccctagatgagccacactccctagatgaaccacgctccctagatgagccacgctacctagatgaaccacattccctagatgggccacgctccctagatgggccatgctccctagatgaaccacgctccctagatgggccacgctccctagatgaaccacgctccctagatgggccacgctccctagatgggccatgctccctagatgaaccacgctccctagatgagccacactccctagatgggccacgctccctagattaaccacattccctagatgggccacgctccctagatgaaccatgctccctagatgggccacgctccctagatgggccacgctccctagatgaaccacgctccctagatgggccacgctccctagatgaaccacgctccctagatcaaccacgctccctagatgagccacgcacctctggcctaacaacaatcacaggctggacctgcaggggagcccgggaggagttctaccctagaaaagaggtaggcccaagccaaggagacacatcctgcctcagaaagacctttctaaaagcgaaacccatccctgagctgagatttgtgctttagagggtgagaggagcacagagaactcactgcagaatcccaaggcaatcagagatcttgtagatgttaacatgcccaggctatatgtccgctggcagcccagttccacatccctgaaacccagagggagccagggtgaggcatccaaggtaaaaggtgcaagggcctgggggtgttgtcaacttgtcaccacctgtgctcctggggagcccaggaccctttgagcagggcgcactgggagaggcctccgtccagggagcagactgactgtacctgctcatacttggtaatgatgtcccctcattcctgtgccagcagggtatccacattctctcccatgtccatcccatgagacaaatcgtccaaaggtgacactgtacccgagagcttcggagaacacctgagccactcctgccgggctcccagatgctggcggtgtgtgacccccattccatcaccacctccaggtgaaaaggggccagacacagtggcccacacctgcacgggtctctggagtctcaggccccaagcaggagtgcctccttcctaaggacttgagaatagtgggacctggacagagaatcccgttgtccccaaatgccatgaaatgggaacatatctatcccaacagaatgaaaggtgtccacctgccgggggtgaagagcctgtgattccagagatgaggaggcagactggggtcagggaccagaggtctctgtatgatcagcctcttgggatcgctcagaaaccacaaagttgcccagttttctatggacaacaagatatctcctgacttcccaattctactccactcatcacttgggctaccatggcccttcagtctgaccagtgaagccgctttaggaatcatgccagttgagcaggaaggtgtttgctttgggggaagaaaatgatctattgtctccaaagcagcctctgtgctggtggaaaccatgacgctgggggagggacggtggactccacaattctgagctatccatacagggtgtggggggcttcattttcccgggtcactgagaaagaacaggagaactctgggttcttggtcctggagaacaccgagatgaacgattcctcctgggaccactcggggcaaaagggaggcgaggcctctggaggaccaaactgagaaagaaatacttgaagagaatgccagtgcctgtacccctttgaacaggagggaagatagtctccatccaggcagccctccagggctccttcattttccacaactgcccaaaggcagaaggctccccatccactcccagacagggaactgtgtgtgtccagtgggtcccacagagaccatcaggacccagcttagggcacagaggtattctgaggcccctcccctccaccccacccacagtggatccatcccagcagctctgccagggccaagctctgccccattgggatctggaaccctggacacatttgggatttagggcagggaggtcacagggttcaggacttaagtccagcacggcacagggcaggggtgagagcacaacccagggtcacatctggattcttggggttacccagttaccgcctctctgaccccagatgtctcacctgtctaatgggcacatttgggagcagcacccaccctatggagccaccatgaggacgaaggaaacatatcattaaaagatcagaaatacaaaaagagataccattaagagttcctacagatactgaaacggtcattaggtaatagtattaacatttttattctgatattcaacagcagcagtcacttccctccacccatatgtgtatcgtctgcctgggcagcacagaacaggcacctggtgagtgcccagggatgaccctcctcggcagctgcccagaggccagcactacccaccccatagccactgtccccaagtcagcatgaagggaagggagaatgtcacactcacctgattctgatgaattggctgggctgagttatgcctctcatgtagcaaactctcatgaacacagaactgctcacagatagcactgtgcgtgtgcaactgctctggaacacagaggcaggctggagggcgagcgggtgctcagcaccagtgacattctgaggtcatggcacacatcacagtggggccttgcctgggtcatcagagcccagagtcagcgtcctccactgcctgaggcgtcaacatgcctgcatgcaatgtgtgcacttgtgtgcacatgtgtatgtgggtaaacacatctgtgcacctgtgtgttgcttctctggccaggcctggctgccccactcatgtctgcacccagttcctcatcactgttacccccgaggcccaggaccagcatcagagcatccatgggtgctccctaacttcagccctccccaaccagggtggtcctgggatacacataggggtggagggaagttactgttgctgttgaatatcagaataaaaatgttaatactattacctaataacctttcagtatctgtaggaactcttaatggtatccctttttgtatttctgatattttaatgatatgtttctctccatgacccttggttattctaggtagagggtcctgtggggaaagtgcctggcaccctgtaggggctcactcttctagaaatgtgatctgaaatctggctcacctgtccttccacccagggcctaggggatgccgagttccggagaccagaaagagcttgggataaaaagaaggtttaaggggaaggctttgacctgggctgggtttgcctgcgccatccaaacctgcaggctcgagtcctgagacacagggggtccagatgtcccaatgcagggccctcctcattaacacctgctcccctgtactcattagtaacctcacccatcctaccctcaaagcacagttggccctggtatccgtgggctctgcatgtgtggattcagccaacagtgggtggaaaatattcagaaaagggagtgtggatggctatgtctctgctgaacatgtacagacttttttcctgtcaccattccctaaacaatacagtataacaacccaatgacagccctagcaagtagagacaatgaaaaagaccggctcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaacacacatgagaaaatgctcacaatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagacagtttggccattcctcagggatctagaactagaaatatcatttgacccagccatcccattactgggtatatacccaaaggattataaatcgtgctgctataaagacacatgcacacgtatgtttattgtggcactattcacaatagcaaagacttggaaccaacccaaatgtccaacaatgatagactggattaagaaaatatggcacatatataccatggaatactatacagccataaaaatgatgagttcttgtcctttgtagggacatggatgaagctggaaaccatcattctcagcaaactatcacaaggacaaaaaccaaacaccgcatgttctcactcataggtgggaattgaacaatgagaacacttggacacaggaaggggaacatcacacaccggggactgtggtggggtggggggcggggggagggatagcattaggagatatacctaatgtaaatgacgagttaatgggtgcagcacaccaacatggcacatgtatacatatgtaacaaacctgcacgttgtgcacatgtaccctaaaacttaaagtataataataaaaaaaagaagaaaaagaaaaagaaacagacctgctcacattgtccagctttgaagtcttggaagaagttgccaccaggatgcaggtaggggtcaatctcctccaggatccagagagcatatcagccagcttcagggtcaggaaaggagcctgacaggtctgcagtaggacggggctggggctggccgtgtggatcacgtgggcctaatgagggggaaagtaagaccatggggcaaaggagggagcatgggggcagctggtggcctaagcagaaggaacttcagagaaggggtctgcattagttcattttcacactgctataaagaaataccagagactaggttatttataaaggaaagcagctaaattgactcgcagttcaggaaacttccaatcatggcggaaggcgaaggggaagcaggcaccttcttcacaaggcggcaggagggagtgagtggagaatgaggaagctccacattttaaaaccatcagctctcctgagaactcactcactatcaggagaacagcatgggagaaactgcccccaaatccaatcccctcccaccaggttcctcccttgacacatgaggattacagctcaagatgagatttgggtggggacacagagtcaaacctatcagaggctcactctgtctcgtggctcccccagggctcaggctgagtgcagatctgatctgctggccctgctctacagcacgctggggctctgcctgtgcatccccatctgtggcttcccggcgtggcggcctgttccctcaaaaggagggtggctctgctctcctgccagccccctgcagggcacgatggagccctggccacgtcctcccagggtgagggcatgaaactgggctccttgcccttcttgctgcttgggtgacaagctttgggtcatccctaggtcctgtcactgttcctgcttctaaatggagagcattttgccacatcttcctgggagaggctgggggttcgtccttgttatttgttctatcttggtaaaaccaggttaagttatctgggcaagcagacaatagagtggcacccaggaagggtggggtgtagggtgctggcctttgggcttgcctggaccatggttggaggggggaaggttaccaggaagcaggactgtcagggctaaagtcaggaggaagtggttatgctgaggggggaggtgtgtggctggcttggggcaggacgtaagtaagagccaagctctgtcagctcacagagagggccgctggcacctagtctagaggctgtggagcccaggggttgcccttagttcctggatccagggagacttctggagcctgtgcctatggctttcaggcacagggtgaagctggtgagggcagggggaagggtgagagaggaggccttgcatggcagggcaggacaggaagctggccagagaccagtttgcagtggctgctcccatcctcacccccacccccaagcacacccctaccccagctgggcctgggcacgtgtcctctgctttggtctcagcagatcacaagatggaagctggcagcctagtgggtgtgccactcaagccagtggtgacctgtgacttctgcttcctggatcgtggggtgcccacccaggagagcacaggtatgccccacacccctgaccttgagggcgctgggaggtgggggaccaatgtgctctatccctgtgtgtatgccctgaaaggtggcctaggagtcctgtgtgcgcccatccacgtggggtcccaggagcttcaacggtggcagggagggagacgaggagggagaaagaagtggagaagaaggagagagaaagagagttggggagaagagagtgagacagaaagagaggaagagagatgggggaagaaacagagaaagagagatagggagagagacagaggaggctgagaggaagaggagagagagagatagggagagagacataaaaagcaaagagagagacagggagagaggtgcatgagtaggaggtcgggtcattcttgatcacagttccagggcaacctgtaggttgccattaactaaccacacatataataaaggcttctgcctgctgcttacagccctcaagaacctctactcctggagactaaaacctttgacggctgcccttcctcactggatgtttgtcgtgtcttctgacgaaccgtgatgcctctttgtaggaatggtatcaataaagagccagatttgaggaggagagtaacgtgaggcattccaaaccattttcagctgaaaggtctttaattaaggtttcaaactctttagtagttggattgctggcgtcatcagtgctggtgccctccttttctttctttgattcattgtttaaatctgttgaggattgaacaactgtgaagttgacctgaatagcaccttcactcctgacagtcacatcttggtaactggattatacctataataaaggaggcagatcagaaccacagtccttcagctggagtaccccagccctgggaaaacaggtgtgcagagaatgtgtgaatccttgggataaatgtggtgcatcttcctaaagagacattttcatgttgagcaatttattatttttgatacattaattaataaataaaactcaggggacaggcttgcctgggaggacttagcgagtctcacagtgtcctcagggtgccgggaatgttggctttgtttcaaacccatttcctttcacagagaacctagccatcacatggggctggatgaggtccaggggcaactgagggttcctggccaaggccacaccctagtgttacctgtaggcttctgaactaaccccagcctctgacagcccaatgggtgatggcaaccgggtctccaagcttcttctatcgcaattttcctcttctccttttcatgaccaccatatctcctatccactctctgtatgcaatgctgcaggaatttttacagttcagggaagtaatcctgttaggcgagatcaggaaatgccataagggattgctgttttcttgattttctagaaacagagggcctccccaactgcccccaaacccccaccccactgcagtgagcatctctctctttacccttggtctggagagcacatggtatttcaaggtcaaaatcgccacctagcggagtaggaatcctctccatgaggcacattgtcagccctttgcagaaacattccagcttcccaattctccctttttgaacccctctactagacaccaggctttctgccccttcagtaaatgggaaaactcaacgatgagaaggaaaatgtcctccaaaaccaaattttaatcttgatactgtcccatcagcaggaaaaccaccattcagtcctacgttctttcaaggcaccagaatattctgcctccaattaaaatggtacttaggctgggtgtagtggctcacgcctataatcgcagcactttgggaggccaaagcaggcagataacctgaggtcaggagttcaagaccagcctggccaacgttgtggaacaccatctctactaaaaatacaataaatttgccaggtgttgtggcgtgtgcctatactcaggaagctgagacaggaaatttttttttttttttgagacagagtctcgctgtgtcacccaggctggagtgtagtggtgcgatctcggctcactgcaacctccaactccctggttcaagcaattctcctgcctcagcctcccgagtagctgggattacaggcacgtgccaccacgtccagctatttttttttgtatttttagtagagacggggtttcaccatgttggccagaatggtctcgaactcctgacctcatgatctgcacccccctcagcctcccaaagtgctgggattacaggcatgagccaccatggccagcgaggcaggaaaatttcttgagcctgacaggcagaggttgcagtgagccaagattgcaccactgcactccagcctgggcaacagagtgagactccatctcaaaaaaaaaaaaaaaaaaattaataagtagattttatgcccggaagttaactggagccactacctaagaataaatactttagtatagaccataataacaaactgtagagctcaaaccagcacactccctccattaaggggccttgcccaaatgcaactgttacatagtcctccccaagatctatctattggggaaccacacaggtcacacaagtctaagaagtcaaagggaaatcaccagcagaggactagagtcacatggatgaatgtgactaatccctttgcttagttcctccgattccatggctgagggtcatatctgcattactgggcagcacctttaacagatgccagggctcagggaaccaaggaaggaaaaacagttggggggtcgaccccactgtcttcccctccatcctgagccattgaaggagggagaccaaagggatgcctttttcttgcttctctttctagatgggtaaagaccaacttcagcctgtacttctctggaatgcattctgaatcactgggactcctttgaccccaagactttgaaggaaaagcagctcattttcttttgcgcaagggcatggccttcttatcatcttgaaccagcctggcctgtggaggggagctttgattttaatactatccaacaattagatcttttctgcagacaggagggcaaatggtccgagatcccctatgtacaagctttctttgccctgcaagacaacccagacctttgcaagtgttgcacaattgactcaacttttttagcagtcatatcagacgggccaaaagggaatgactccccaaaactagagaagcaacttccaggggaacaatctgaggcagctattgagtgtccaggcccttgttgtcccccttctctggggccccctccaaccatgccattagctccttcagccctaccacctctgaaactccccacatccccctacaggaaatgcccaatggaggtgatgccactaaggttcaagttcccttctaattgcagaaccttaggaaaataagggaagacttaggtcaattttctgatgacccttatagatatatagaagctttccaaaatttaactcaggtgtttagcttctcatggaggaatgttatgctgctcctaaaccaaacacttactacggctgaaaaacaagcagctctgaaggcagcagagaaattcggagatgagcaatatgtctcctatagtaggccaaaaagggaaagagaaaatagggaaagtgaagaaaggaagaacggagaaccatcattcccaataggaagaaaggcagtaactcctgacaaacctgattggaaccccagtgataccacagatgaatggaaaaggaaaactttttaatgtgcatattggagggcctacaaagaactagggccaaacaccttaattactctaaattgtccatgataggccaaaagccagatgagaatcctgcagcctttatggaaaggctgagagaggcactaataaaacacacctccttaacccctgattcagtcgagggacagctcatcctaaaggagaagtttattacacaagcagctcctgatattagaaggaaactgcagaagcaggctataggaccagatagtaccttggagaacctgttgagggtagccagcttagttttttataatagggatcaggaggaggcccaagagaaaggaaggaagcacaagagaaggacagagactctagtagctgctttgcaggcttgcaaagtccaggatccccgaggtgcatatgctagttgctactaatgtgacaagtcggggcactttaagaaggagcgcccaggcagcaagaaaaaaccattttgatcctgtccagcctgaggcagggaccactggagaacggactgcccccagagacagaggtcaccaggttcagaaccagtttcatagatggtccaacaggactgatgggtcttggggttcaaacccccagatccagtagcttaaactaccattacagcacaggagccctgagtgattctggaaattgaaggaaggaaggaaggtggacctccttctggacactggagccagattctctcttctcttctctgatctaggcttcccctcttcccatagcataactgtaagcatctcaggaaaggttctgacctgatatttttctcaacctcttagttgtagttggggggatctattatttatgcacaccttcttaatcatagctgaaagtcccacctctttactaggtagagacatttcagctcgcatggggatcaacatcctcatagccccaggacaaacacttttctccccctggtggaaggtaatatgaatccaggattgtgggcaactcaaggaagaatagattgagctgtaactgctaagccagttcagttccaccttaaggatcccacttcttttcctaaccagagacaatatctcctaaagccagaggctagcaaagggctagaagcccttattaataacctgaagatgaggggcttcctcaagccctctaacagcccttgcaataccccaatattaggagtgcaaaaacccaatggggaatggagactggttctagacctctgcctcattaatgaggccatagtcccaattcatccagtggtccctaatccctatatcttgctgactcaaatacctgaaggaactaaatggttctcagtcctagatttaaaggatgcctttttctgtataccattacatcctgactcacaatacctatttaccttcaaagatccctccagccaaactgcccagttaacatggatggtggtgcctcagggatttcgagacagtcctcacttgtttggacaggcattgtcaaaggacctttctgagttttcccatcctcaggttaggatcttgcaatatgtagataacatattgctctgtaccccaattgaggaagcttctcaggaaggcactgaagctcttctgaatttcttagccaagagagggcataaggtttcaaactccaaggcccagctttgccaaacctcagtgaagtacctgggtttagtgtgtctgaagggaccagagcattaggggaagaaaggattaatcccatttcctccttccccctcccccaaccctcaggcaactaagaggatttcagggcattagaggattttgcagaccatggatacctgggtacactgagatagctcgccctttatatcacctcataaaagaaacttaagtggctaaagctcatctcctgacctgggaacctgaagctcaaaaggcatttagccagctaaatcaagccttacgtaaggcacctgccctcagccttcccacagggagggccttcaatctttatgtatcagaaaggagggaatggccctgggagttttaatgcaagcctaaggaccagctcaatagccagtggactacctgagtaaggaacttgattttgtggctaaaggatggccagtatgcctctgagcagttgctgctgtggccctactggtatcagatgccaccaaatcaaccctggcaaattacttaactatttatacccccacataatgtagcagaattgctgtcttctaggggaagcctttagctaacagacagctggctctttaaatatcaagctctgctgttagaagggtctacaatccaattgaaaacttgtcctcacctaaacccaaccactttcctccccgaggaaactggggaacctgaacatgactgtgagcaagttgtggtacagacctatgcagccagggaggatctcagggacactcccctacaaaatccaggctggacccttttcatagatggaagttcctttgtagagcaaggagtctgtaaggcaggatatgcagtcatcactctgaatggtgtttttaaagtgcatccctctctccaggcacaagcactcaactagctgaactaatagctcttataagagcacttgaattaaggaagggaacagtagctaatatttacactgcctccaagaatgcttccttagttctctatgcttatgctgccatttggaaggaaaaacactttcttactgctaatggatctcctataaaatatcatcaggaaattaacaggttattatcatcggttttccttccacaaggggtagcagcgatgcattgtaagggacatcagaagggaacagatgaagtagctgaaggaaacatgttagctcatcagacagccaagtcagtggcaaggaagcctcagggcacaacacacttgaagccgcttgaatttgggaaggctccgtaagagaaatgaagcctcagtactcccctgcagagatagaatgggccacctctcgaaggtacactttccagccctcaggaccgttgaagtcagaggatggaaaactccccttgccagccttcagccattggaaagcccttaaaatccttcaccaagcttttcacttgggaaaggatataactgatctgtgtgcccagagatcgttttcaggagagaacttattaaaaacagtcaaataggttgttaatgcttgtgaagtctgtcttaaaaacaatcccctcaacaggcagctccttcctcctcaaacccaaaggatgggaagctatcaaggggaagactggcagatagacttcacccatataccaaagatgaagggcatccaatacctcctagtatgggtagatactttcactaactgggtagaggcatttccatgccgtacagaaaaggcctctgaagtaataaaagggtgagttaacgaaataactcctcactctggtgtgcctaagtacctcaaaagtgacaatggcccctcatttaaggcagccatcacacaggcgttctcaaaggcactaggcatatggtatcatctccattgtgcttggagaccccagtcctcaggaaaggtagagatgaccaacgatgttatcaagacacatcagaaaactgtctcaagaaactcaccttccttgggtcactcttctttccatggctttactgcgggtaggaaataccccttcaaagttaggtctgagcccttttgaaatgctgtatggatggcctttccttaccagtgatttcttattagaccaggagacctctgaattggttaaggatgtaacttctctagctcattttcttttttttttttttgagacagagtctcactctgtcacccaggctggagtgcagtggcgcgacctcggctcactgcaagctctgcctcccggcttcacgtcattctcctgcctcagcctcctgagtagctgagactacaggcgcccgccaccatgcctggctaatttttttttgtatttttagtacagacggggtttcactgcgttagccaggatggtctcgatctcctgacctcgagatccgcccgcctcggcctcccaaagtgctgggattataggcgtgagccaccacgcccggcctctagctcactttcaacagcaatgaacacaactggcaaaagcccagccctcaaaaacaggagcacctctatttaacccagaggatttcgtcttggtgaaagctctcccttctctccctcctcccccacgcccaagctgggaagggccctattctgttcttcttatatttatttttatttttatttttttttgagacagagtttctctttggttgcccaggctggagtgcagtggcgtgatattggctcatcgcaacctccacctcccgggttcaagcgattctcctgactcagtctctggagtagctgggattacaggcatgtaccaccatgcctggctaattttgtatttttagtagagacagggtttctccatgttgatcaggctggtctcaaactcctgacctcaggtgatccacgtgcctcagcctcccaaagtgctgcgattacaagcgtaagccaccgcgcccagcctctacactgttcttcttttaaccccctcagcagtacaagttataggtattgactcctggatacatcacactcaagtcaaagcatgtaaagctaagaggcaacccctgacagcccagaggaacgtcctggatataaatgtgaagaaatagaagatgttaagctgaaaatcataacagataagtaaatgagtgagggcttctctacctactcagtcacacccctaccttaccatataccttcagtcatttctacttttcctctcgagatttgccatcaaatattaaaacatctttttgaaatgtactttcagagagattttgattatccaggggattacatttgtaacttcacagacccccagagggaaagtctatatcttggtgagtaaaattttagatggaaattatctactatacctcccttgcaggaattgttgtgctcactctacttgtagtaggactgtatactgtcacacccccagaatggaatattggatgaagaatctcaatcactgaagtattttgcttaattattatccttacagcagggacaatagttactgacgacaggtaaacatgaaggttttactatcactgagtcagctaggactttttctttttcttttttactttttttttctgagatggagtctcgctgtgtcgccaggctggagtgcagtggcacacaatcttggctcactgcaacctccgcctcccgggttcaagcaagtctcctgcctcagcctcccaagtagctgggactacaggcatgccccaccacgcctggctaatttttgtgtttttagtagagatgaggtttcaccatgttggccaggatggtctagatctcttgacctcgtgatctggccgcctcgctctcccagagtgctgggattacaggcgtgagccaccgtgcccggcctacctgtgcacttttaaatgaaacatgctgcttctggatcagcatctctagtcaagtagaagagaacctacaggtgcttaaagaccaaattagaatcattgacaagttaagagaaaacgtggattccagtcttctttatggaattgattagttccttttttaagcccgctcttgctcgtgtgttttgtactaatatttggaccttgtatacgcaatacggtaacttgaattatttcctctcacctagaagctattaaactccaaatggcgccgcggatggaacctcgcatggacatgccattcttccaaggacccttagatcgactccaggaggagctctagctgctgtgccccactcaatgcccctctcttcagcaggaagtagccagaaagtcattgcccaataccccctaacaggagttagggttaccactcctgagaggggaaatatgatacaggagctagaaagaaattatttggcagacagtgagggtgaataagtcctcagcaaggtttcccttttaagaaaacgcagcccccaaatcatttcttttctaacaaagagcagcctgaaaaattgagctgcaaacataggtaagcaagttggaagcttgcacggggggatgccggcacctgtgctgatagaagaaagctaccgggggccaggcatgttcaacatggaggctccatcttcccttttgtcaccatgtgtacagtaaaaaaagcaggcaacatggcaccggccaggtagagaatccatctgaataataaaagattagggtggggcggccagcttctttgtgcactatgcaaacagcacacctagtcctaaccagttctttgaatgctatgtaaacggcacaccttgtccaaccaatctttcattccctatgtaaattagacaccacctcctcaagcacatctataaaacctcctgcacttcactgcagaccagaagacctgcttgggacctcctctctcttcaggagagagcttttctctttctttcacctattaaacctccatttttaacctctctccttgtgtgtctgtccttgatttccttggcatgggacaaggaaccttgggttttaccccagatgaacgatgccacttcaccactatgttgcccaggctggtctccaactcctgggctcaagcaatgttcccgccttggcttcctgaattgttgggattacaggcgtaaaccgctgttcccagtctgaaaaattttcttcagagagaacaggctttgtcagtggtctacttgaacagtatactaaattcatcaggtttggggatccaaaggaactgtccattatcctcatccatcagcaaaaagaataggccctttggtaaattatttttgtaagtgcttaatcctcaattacttgttgctgggccttgtcatcaccaggaatcattccgtgctttgtgtccttaatgccagcattcacgatttaaaactaagctttctagcacttgcttcactgtttcaaccactttcttcctgggactttcaaattctttgactcctgtgttagttcaagtctacagaaaagtagatgtcaaggactacatgtgaaagaggtttattagagaaggaacagaaggcaggacaaatcttcagactgattgcaggtctgactatggaaggagagagggaaggaaggagggttgggtaggactggactgtagcaaaattcagccaggccacagggagtctttgagccaaaattgcctgttggaggtctgtatgtcaacagaatgggcattcccttaacgcacctcttttattaatctaatcatccgcagtccccattactctagtcctactgttgaaaatcatacaatagtagagaatactgaagccactgttaaaggccctccatagtatcccttcttaattccgattgtccacagcagttaccacgactcctcgtccttctcagctcctcttctattctgtctcaagtaacactgcttgtgttttctgagagaatatggcacctgtaggtcattaatttatctaaaaagaacacgtgtagtcaatttctttcatctaagctaagagcaaaatgtgctttaccagtcttaggaccccatcccttttcctacaaccatgttgatccctctgagctgtatttaaaaatactcctcagctgacttcattcttacactctagttccttttttttttttttttgagacagtctcactctgttacccaggctggagtgcagtggcacgatcactgctcactgcaacttccgcctcctggcatcaagcgaccctcctgcctcaaccttccaagtagctgggattacaggcatgcaccaccatgcctgggtaattttttgtatttttagtaaagatggggtttcgccgtgttggacaggctggtctcgaacttctgacctcaggtgatctgcccgcctcggcctcccaaagtgctggggttacaggcgcgcgccaccatgcctggcccaccctaggaactttttttttgtttgatgggtcttgctttgttacccaggctgcaatgcagggggttcttcacaggtacaataaataatagctccctgcagcctcgaactcttgggctgaagtgatcctctcacctcagcctccgaagttgctgggactacaggaacctgccaccatgcccagctgttttataaaatatttttagaaatgggggtttcaccatgttgcccccaggctagacccatgggctcagttgtcctccctcctccacctcctgagtagctgggactacaggtgcacaccaccattcctggcaagaaaacattcttttttttttttttttttttccgagactgagtcttgctctgtcacccaggctggagtgcagtggtatgatctcggctcactgcaacctctgcctcccaggtccaagcgattctcctgcctcagcctccagagtaactgggattacaggtgcccaccaccacaccaggctaatttttgtacttttagtagagatggggtttcaccgtgttggccaggctggtctcgaactcctgacttcgtgatccgcccgccttggcctcccaaagtgctgggattacaggcgtgagccgctgtgcctggccaagaaaatattcttaattccatttaggttcacataaattccatttaggttcatatccaacttcagatgaattttcttgatagaacaaatgtgcagacttttcagtaatacagactgaattattcaccaaaactatattgacgctacatgacagaactaaaaaggagtaaattagggtcagtttaatgtttcattaggtatttagagaccaaaagaaaccacaaaatcttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactagagcctgcgcatgcgaacagcggagccttcctgcttttctccctcacttccgcttccgcctcggctcagccgcccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaa

SEQ ID NO: 642 - DNA, 912416 bp, Homo sapiens
gccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcgcggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggcatggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattcttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccctgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcattgcccttaccagcaatattacctagtggcgtgaggttaatttaaggaccaccatgaccactaagtgctatgttttcatacttttccacacctcatcagtgctcctttttttgtttgtgttgctcggtttccattcatttttgatgttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgaagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctatcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacgcctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgaatcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccatcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggagtgcagtggcgtgatctcggctcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatggggtttctgtgagtttggtactcaagggaatatagtgttgtcaactgtgaaacaccaagaatatattcacaaactgcataattttatagtactgattccaagtaatctaaattgggatttcctttggtttgtagctggagtgcctccatgaacacatagggttaaaaatatcactcgatttagctgtggcagtcattccaagtggcagcagccaaagcaaatgtccagaggtaaaacgaaactcgaatgcagacagtggcagtggttgggaagcaccttggtcatcagtagaagagctggaagtgagggagtggggacagaaggcacagagtttacaagtctgccaaaaaactctgtctgcctctttctggaagaagcagaaccggggacttttacagatttcctccttgcctcagcccttcctagctagatcatcttttcctgctagtcccgttatttttactttcttaggcacctgatttgtttcctttccaagatcccattgacttggtattgttatactttccctgttcaacattgacattcttgatcttttccaacaacctccacttcagcatgatgagataaaagcagaaaaggctaattataaagaaggctatcttcccccaagtaaagtaaaataaaaggaaaatccaaaaaacactaaaatcagagtcaaccacaatcagcggagatgtacttactgctctgcttgccattttcattaccatcgcttatagatgggtattactgttatgtaaaatacagagctctaccattgtgtttctaattgtaatctttttatttattttttatttattattatttttttgagacggactcttgccctgttgcccaggctggagtacagtggtgcgatctcggcccactgcaacctccacctcctgggttcaagagattctcgtgcctcagcctctccagtatctgggattacagggacataccaccatgcccagctaattgttgtatttttattttatttttatttttatttttatattttgagatagagtcttgctctgttgcccaggctgcagtacagtggcatgatcttggctcactgcagcctctacctcccaggttcaagtgattctgctgactcagcctcccgagtatctgggactacaggtgcccgccaccacgtccagctagtttttgtatttttagtagagatggtatttcgccaggttggccaggctggcctcaaactcctgacctcaggtgatccgcccacctcggcctcccaaagtgctgggattacaggcgtgagccaccatgcccggccaaattgttgtatttttagtagagactgtgttttgccctattgcccaggctggtctcgaactcctgacctcaggtgatctacccacttgggcctcccaaattgctgggagtagaggtgtgagccactgtgcccggccatctaattgtaatgttttaaattttatatgtaaacaagatgaggtgatagtctgtattcttcattagaaaatcaaaatgttaataaatgatatgattagttgcctaaattataaatcgcccactctgagcctgtgccccctacccaagacctaccatatttagtaactcagaaggagcttccacatattgcctccagcccattcagcggatgtgctgtttcagttaagtaccaaaaggcatttcaaggtagactatcatatcagtagtgataattgaaaatatttttttttaataaaaaacaaaaaggctgggcgtggtggctcatccctataatcccagcactttgggaggctgaggtgagaggatcatttgagctcaggagtttgaggacagcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagcatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgatccgcccgccttggcctcccaaagtgctgggactacaggtgtgagctaccgcacccagccgtaaggttactaaactattaagatcaagaaaaggagtggtgatagtagaagaaggtaaattcagttttggataagttaaactgaaagtgatagcagaacactgaggtcaagatgtccagaagatttttggaaatatagttacagatttcatgacaaaatgaattcttgagtgttctggatatagtgtggataggggaagggattgttatagggatttttaagagaaaagaaaaccaaagacagagacttggaaacaccttcactaaggggctaaaagaagatagacaaggagcaattgggcaggtaggagaatccagacattattgtcctagaaacaaaggaagagggaagtcctaagaagggaggagaggtgaacatttttgacaatgacatacgctctggtggaataaaaaagggtaaaaaaccgatgatttgctatttgggagctttctaatgactttttgaagagcatcctttcaatattgtgatggaactgggaagagaatacagagctatgcagagtagatggtgaggctatagggaaagatcatattcattcaacagttgagcagtcttattgaatgcctcctcggtgcattatactgagttaggtactgaggatacaaaatcaaacgggagcctagaggagctcacatactgtttgggaaaacacgaatataaaccatgtgatcaatttacaatgcggtcttctatatgctgtaatagagataggaacagtaagcctgtgcagcataggagttagagtaaccactcccaaccccccacctctctcctttgtgtctgtataatatgggctattctttctagcagtttggtgggtgaaaggtacatctcatttttccttcacaacctagtatggatttatcttctctgaattttgctaaatctttcttgatcctgtgttgttacagcctttgttaccacataagataataagttgcatacatttaccatctactttgtaaagaattgccctggctgtgtaattgtaagatcaaagataagctttggaggaaaaagaagcacatagagagacaccttgcaggagtgaaaatgactctttttttttttctttttttccttttttttttttttgagatggactctcactctgttgcccaggctggagtgcggtggcgcgatcttggctcactgcaagctccgcctctcgggttcatgccattctcttgcctcagcctcccaagtagctgggactacagggcctgccaccacgcccggctaatttttgtatttttagtagaggcggggtttcaccgtgttagccaggatggtctcaatctcctgacctcgtgatccaccctccttggcctccaaaagtgctgggattacaggcgtgagccaccgtgcccagccagaaaaccactcttaaaatacaaatacacaactccacatctgttttattgccaaatagctatagatacttagagcttgcttctctttcttcaaccaacccgacttttttattctttgcccactgtaagtaaatataaatgggcttctcagcaataggtggatatctaacttagcattttggctatgactggattttgatatatagttctagacattaaaaaaacacacaagagaagcattatgaagaaatgaaaccaggaaacaataaatgtattttggttttagaaccacacggggcaaccaagaaaactaaatttcaaaaatcaggagcaactcaggagacacatgatcctagttttatgtgtcagcaagataacagtataaatgagaaggtataatttaccatttgagaacagataggggacaagaaacaatgttatacaacagagaaaaagaaacctccgtatgtattagggaagaataatttcacagcaaaacaaaacccacatttccccaggcctcactgcctcatgtaaataagaaaactcaaattttgctggctcttgtctctacatacacattcagcacctcatctgctataagggatctatgaagcatttctgggagttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccaggcagcagtgctagggccttggagtacaaatatgggtcttgcccttaaaaactcagagcctcatgggaaagacatatgatataaatttcataatataagtgttcaaaaagtgctaaaaagagcaactaaccgcctggagaattcaagagaggcttcatgatgaaagtggcctttgatctatgtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacacacacgtaaatgagtttgaggctggagacagattttggggacatctgcacatatatatgtttattgaaaccttgggatcacccagaaaggacatctcaaatgagagggttgaggatggtacatttgggaattataatatttaagaggtaaatagagaaatcaacaaaggatactcagaaagaaaaaaaaattagggaagaagagaagcagtaaaaagtggtacctaagagctgggcatggaggcacgtgcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacagggtagaagagggtaggatggaaaaggtgccaaaaatgaataggagttgggcacagtggctcacacctttaatcccagcactttgtagagccaaggcaggaggatctcttgagcccaggagttcaagaccaccctaggcaacacagggcgaccttgtctctacaaaaatttttatttgaaaattagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatgggccaggcgcagttgctcatgcctgtaatcccagcactttgggaggccaaggcaggcagatcacctgaggtcaggagttcgagaccagcctggccaacatggtgaaaccccgtctctactaaaaatacaaaaattagctgagtgtggtggcagacacctgtaatcccagccactcgggaggctgaagcaggagaatcgcttgaacccgggaggtggaggttgcagtgagccgagattgcaccattgcactccagcctgggggacaagagtaagacttcgtctcacaaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggatcacgaggtcaggagatcgagaccatcctggcctatatggtgaaaccctgtctctactaaaaatacaaaaattagccgggcgtggtggcacatgcctgtaatcccagctactggaggctgaggcaggagaatggcttgaaccaggaagtcagaggttgcagtgagccgagatcgtgccactgcactccagcctggcgacagagcgagactccgtctcaaaaaaataaataaataaaataaaataaaatttacttttgggacagacatcacatgtattggctaataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaagatactcaacaggttgtcataagtaccttaaaatttctagaaaattaagtgcttttacaactaaaggaaaataaacatttattctaattggtggccttgattatgggaaagtttctctcatacaggctcatttctatattattaagtattttcctaaatagggataagaaattttaagctctgcttgctttacagcagaatccatctgctttcccagtggacatcccaagacaaccagatttacctggacatgaatgtacttctgacccttcaattttcattaaacctttagatacacctcttctgtgtattaaaatttgaaccttactcctggtagttccttttcttgttgcccattaaaatgagaggagtggaagctgaaagaaggaaggaagaaagcagtaggtatcttaagcgccacagttgttttgttttgggttttgttgttgttgtgattgtttgttttgaggtagggtcaccctctgtcacccaggctggagcacaatggcatgatcatggctctttgcagccttgactctcatgggctcaagggattctcccccacagcccctcaaccccacccccagcctcccgagtagctggaactataggctcacagcactgtgcctggctaattttaaatttttttgtagacagagtctcactatgttgcccatgctggtctcgaactcctgggcttaagcagttcctttgcctcggcctctcagagtgctaagattacaagcgtgatccactgcactcagcccacagaacccttttgagatttcagttcttctattatttcttggtatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtggatttaattctattgtcatatcatcaaccataaacaatcatgaattgaaaagaaaaaggactttaaaaagtacttttctagtacatagattttactttatggtccaaatttaaacaaactcttttgcacctggaagaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttgttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctagagatggtgggtggtgcgttagctctgtatgtaacagggaaaatcctccacaggctgtaaaatgttgaaagcacggttaaaataaaaacaaaccaccgttacattttttacggtagtttgggttataggactacaatgtggccaaatgaaaaggttttttaatttgacttgcgtgtggggcagagaatggcagggctttgttgaggctccctcccttgtttatttcttcccctccaaagcatgcctgttagatggttcttctttcttatcccatttcacttgtcattttatttgttttcaatttaaatatcacgctatttaagaaatagtcactgcttttgaagtttattttacagagctgtaagttttattgagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaagattgttgggaaggggtggaggaaggtagtattttcaattggttacccggcttttaacaaaacaattcctattataatcccagggaatttcatctgactaaatctccactcagacgacaagcaaggagtgagagctgcagccaaagggacaaagagtggggggaaccagtggctgaatgagtcccaccatggtgccctttagtgggtcccattgtgccgtgggttagcacttctcaccattgcttatgaaaatactcagcattgaataatgctgtatgtcttacattctactcactaaaattgcttatgcaatttcaattggctatggtatttatcatttactgtcctctgcattatatagcatggttaagcctaagaagcagctgccttttttttttttaagtggatcaagcgattgttatgtattgtgtgaatatcagttcaagtttcttgagtgctgtagcatctagatgaagggtagtaaataaacattaggctcttaaaataaaaagacttttatgcgattcttcaaattctacattgcctggaaataaatagtggctattggtcccttttattttaataaaatttagatatatccaccagctgtgagcacatataaatctgcactttaatgttaatggaagttaggcatgggtatcaagaggtaaaaatcctagaagatattataaaatcatgttatgtagctcagtttttacagtggttcgaatgtaaggggtattctacatgccataaattactatgtatacaatctttaacctacaacatccttgaataaatagctttagaatcataagcttggttagtttcttttaaagtatagggaggcggtgaatgtattttaattataaaagcctcttagaaaatctgacatggtaaaaggagctatattatgtgtacacgtatgtagctcctttggtgtttggtaagagcactagttgccactctagtattttttcccattgtctgctcaggctgttttcggtctgagactttctcatcccgcagcccccacctctgtataacttttgccctgagtccttcaattgcatagactcttttctttctcttttcatttctgaggtgaatctgggagcccttatgtcccacaatttactgaagtgctataattatggcctttatcttttattaacatacctacatgctatgcttttctgtggtagcccagaatattaatgcaattagcacccttcattaagatgtactgtccattttgaatgacagctttaagtcacaggataagcctcctatacaatgggctacttttttttttttttttaaaggaagaagggaagatttgtaatttttaagaagtgaaaacttctagaaaatctttcattgctaatcctcccaaaccacccaaaaaagagcaagttttgacgttgaaacttcaggaaatcttcatactgataggatcttttccacactttaaaaagttaatccttaagttaatcacaatgaagacaccctgcttatttcctacagtggctaagaagataaagtgagatggtgaatgtgaaacttctttgaaacttttaaagtgtatttatttaaaatttgaatagagctttaaagtgtttaaagattattatcaatactatgttaaatcaatgccacttaaacccttcagtatcttcccatttcttctaggagaaatttaaattttttacagtagctcaaaaggctctgtgtgatctgacatgtatgtacattacctgccgcatctccaacagtccaacgctgtgagaaaatgtgatatccattacatttgaaccacaagactgttgttatattagaaagggaagcattgttttggtgcagatatcttctagtattcatctctcaaataagtctttttggtaaaattaagcaggattttgacattagaagacatgatgccgaatttaagttgtatgatgattattttgatgttattatgaaaataagtgcaatgttattggtttcatttatttctattatataattgattaaaataatgaacaattaaaatgtaagcaatgatttatggggtgcttaactcatagcagtaaatatagtatattgaacttacagttgcattgcctgttagacactatcaatatagaataagtctgatattttctaaatggaacaattagaacaaaccttattttaaagtgtgcctttccccatactccatgttccaaataattataagaaaacctactgcttctgttattacacgtttacaaagcaatagaaatattgcctgtaacctggccttcatagttcaactttagacttctttttttatgactacatctatactgtggaaaatgttttattttcctaggtaagctatgctattgtagtaaaatttttgaaaggaaaattattttggatcaaggacaagcaactctagcagttcagttgtttttttatctcattatttttcaatctaggaaaaatatttaaatatataacaccaatattttgcttggatagattgaagcttcagatgttttagttagaaatggactgcaaaaataatatctcttaaaaaaagaaacgaatatagtcaaatatgtgtctaagaaatacaacttgtgcatacatcctatagtatctctataaagatttcatcttgtttttctgattgaagtgttcattactagagacaaatgtatttttaagtcttgtgattagagggggccacagccatcatagctctattagaggcagaaatataacattaatattttagtgtttcatttgctttcatgaaacttatgaacagaagctatcagtgtctagggtttatcttcaaatgacaaatttagcattctgtaaaaagtgatactaggacttcctgctgaggtcatctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattacatatccctcttgtcttccttcttttcttggccaacttctttgaagtgtactgccatcatatatttttctcttttaaaatgttttccattattaaaggtaatgtatgttcattgtagaaaatgtgggaatgtgtaaaatataaagacaaaggaaaatgcatagtctcaacatccagaagcaaccacctttacattttgtttttttcttctatcttgtatttctatgcatattttacattgttcatattatactgtatacaaagttgtatatactacttttccacctaaatttataagcatttttacattaatgaatatcttgataagtctccttttaaatggttgtatattatttgaacgtaagaatgtatgatattcactccatccatcccttaaattagaaattgaatttgtttctttttttttgctaccataaataatgctgttgtaaacatctttctacatatagtacatatactatatgtagaaaatcagtacagcttttccctagaagagattcagaaagtaaatgacatgaggattttttactacttactagatgcaaagcatgattaacttgggtcaagtcagtgcataaaatctgtaatcactgatttgaatatactatatttacattctttgaacaaatattttaatatttattatagccaaagcctgatggtacaaagatggaccttaccccaaaggaatatactgtctagtatgaaaagagaaacacaataaattaaactgttaggttgagccatatgacgttgttgtttgacctatgaaaatatttatttcatgtgattcaatttaaaataatataggatgataaggataatattgaagcaagtacatggtggcttgggaacacagataagtaagtaattagatcttccgaagagagataacacagattattgctgcttattcagcagaaataaatttaaacgagggaacttttatatctgtgtaggtgtgtattagaaagctgctaggtcaggctcatgcatcagatttatggtattctgtaacattgcagcacaggaacacttcacctctctgaaagtccactcttccagcaactgtacctacctggaaatgctatctatctcttcaaaatatggcagtaaacctgaaagtaagcaaaaacaaaaatatccctcaacaggcgaaaggaatgtgatcaagtccttaaaaagcagcatgtagacttttatcaaaagagagtcttccaagtaccttactcaaaatctatttattatgttagacatagttctatcaaattggattttctatttttttcaccgtccagcaaatgggaaacagcatacataccaggattgagaggtagacagatactttaagactcactggaagcactaagacgtgatagttaatatcttgactatagtggaagagatgaaataattatcaaagcagataatatcttaaaaaacaaaaagcagaatacagactgtataattggtctcaactatgtaaaaaaaagaaataggtatatatatacgcagctgctaattaaaaaattggagtgaaatacaccaaaatattaatagtctttgtggctataccatggtatatgagtgatttgtacttccttcacattttttacaatattcttcagtgactctctgctgattatatcattagaataaataaaataataattggctgggtgcggtgactcacgcctgtaatcccagcactttgggaggcctaagcaggcggatcacgaggtcatgagatcgagactatcctggccaacatggtgaaattccatctctactaaaaataaaaaaaattagccgggtgtggtggtgcacgcctgtagtcccaggtactcgggaggctgaggcaggagaatcgcttgaacctgagaggcggaggttgcagtgagccaagattgcaccactgcactccagcctggtgacagagtgagacttcgtctcaaaaaaaaaaaaaaattaaaattaaatttgtaaatgaaaaagatctttgagcatagaacagttttggtctatttagagaagaaacaaatagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacctccttcagaatcatgcttctttccttcttaatgtctttctttaaattgacttctttctacagaaatgctcatgtcctccttgaacttaaaagcaatcctcaggccgggcgcggtggctcacgcctgtaatcccagcactttgggaggccgaggcgggcggatcacgaggtcaggagatcgagaccatctggctaacacggtgaaaccccgtctctactaaaaaatacaaaaaattagccgggcgtggtggcgggcgcctgtagtcccagctactcgcaaggctgaggcaggagagtggcgtgaacctgggaggcggagcttgcagtgagccgagatcgcgccgctgcactccagcctgggcgacagagcaagactccgtctcagaaaaaaaaaaaaaggcaatcttcagtgataaaccaaacaataaataaacagagtatgtccctaagttactatcctatgtctagctggggagaaaagacatggacacaccaaagaagtaagagataagatatgtatataacaatatttgtgtaccatgtatgaatttgcaggcactaatacccattgatgagctctatttggctattgggactgtgcctctcctaattgtgtggcttggttggaattgcttcatctgatgtggaacctcaatagtcagtcaatgatttgttgtctctttacttattcactctttattttgaaattttcaagtatatacaaaatacaataatataaaaaaaactcatgaacccagcttccacaatgatcaattcatgatcaattttgttttctccatactgctactcttggatattttgaaacagctctcagacattatgtttttttcatctgtgaacgtttctgtaagcatccacaaaagatgaagactatttctaacgtaaccaaatactattatcatatcttactaagaaaaaaaatccttaataacaaatatctatttagtgtttacatttccctgattatctgctttggtttttttgttttgttttgtttttttgttttttgtttttgagatggagtcttgctctgtcactcaggctggagtgcagtggcactatctcggctcactgtaacctctgcctcctgggttcaagcaatcctcctgccaaagcctcccgagtagctgggattacaggcacccgccaccatgcctggctaattattgtgtttttagtagagacggggtttcaccatgttggccaggctgttctccaactcctgagctcaagtgatccacccctctcccaaagtgctggaattacaggcgtgagccaccacgcccagccaattatctactctttttggttagtatgaattggaaaccaaacaaagttgattcattattatggttctgttaagtctctttttaacaatggaatcccccttgtgttaattatcaattattcatcaattgctgcataacaagttacctttaaaacgtagaagcttaaaactacaaatgtttattatttcatagtttctgtgggtcaagaatttgggagcagcttagctgagtgatcgtttcagtgtctctcatgagattgcagtcaagatattggaccgggctatggttgtctctgggtctgaggctagaggatctactccaagatcagttcttcactatacgggcctctctatagagcttcttgactgttgctatggtctgaatgttttgtccccccaaaatacatatgttgaaacataatcccaatgtgatagtattaaatggtgaggcctttggaaagtgattacccttataaaagaggctcaagggagcatgtttgctccttcagccatgtgaagacacctagaaggtacctctgtgaaacagggaacgagcccttatcagataccaaatttactggtgccttgatattagacgtcccagcccccagaactgtgagcaataaataccactgggtatgttgttatagtagcccaaatggactaagacaagcatctttacaacatggcatctggcttccccaagagtgagtgatctaagagagaaagcaaagaggaaaccacagtgcattctgtatcctagtcttggaagtgatataacaatacttctgtcatattctgccaatcacacaaaccaacccagaaacaatgtgggagggaattacaccagagtatgaataccaaggggttgggataattggggggattcatcttggaggctgactgctccaccttttcatctatctctcctttttttcttgtaattttcaggggttttttttccattttctttttctttcttttctttcgttctttttttttttttttctcaaaatcttgagctcaagcgattctctcaccttgacctcccaaagtgttaggattacagatgtgagccaccatgcccagcccagtttttattgttgaagcaaccaggtcatttgtctgattgagtttatattttgttcattgcatcccactgtgttatttacctgtttctttgcctgtccccctactccatatattttctgtaaatttatagttagataaaccaagccactctaaagcttgatcagattcaggttttgtctttttgtcaagatgtcctttttttgttggtgttgtgaggttttatattggagcacatgatggctagtttactctttttgttatattagcagccactgatgattctctagctccattagttcaaaagagtactattctattattcctcctttaattagtttgattacttcataaaaaaaatgccccctcatcaactatttgattacatgaaggtacatttcatataatgaagggatgagaagtacttctctctttttgtcagtaagttgttgtctctctagaatcctctaaaggtaacaagtgaggtctgggaaccaacatgggtatgctgaagcagagtctccagggataggtgctggtcatggggatcttgaaaacgcttcctatgtgattctaatttggtcctctattaacttctaccaatctccattcccagagtctgacttaggtatgggagggggccaaggattctgtttttgttttttcttttaatctctagatactcctcttcagctgacaagtttggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtaaccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgatattcattttgtctggtgctcttttctttctgcctaaggctttctgataaaatttatgctatatgccccttaataccgatttcatgatggttaaccatatctatgcctggaaagaaaatatagacttgggaagaaaacagatatatagtctacaatgaatatttctagcttgcattcaagatgactgtgttgtgcagaacattctgccaggcattaagtgggatacaaaagcagtctaacatatgatctctgtcctatgaatgtgtttttaaaatgtatactagtcattattggagtgactattatataaagacaaaagccactagggtagccatggttttttgccagttattagccatatatagtgcgtgcatgcacacatacacacacacatacatatatgtaatatataattttagtatatttaaattaatccatattttcaagaacttcattaacttgaacactcagaaataccctgagtgttttaagacataattgcaaataactcatgtaatgcgtatatttttatatctttgcatgtatgaagtttatacattcaggcttgtgcaaatgtgtttatatcatttgcctaagcccttgattatttacatgttcctatgtgggatcacagtccttcagatatgaatcatagcacagtgatttctttacatattcgtattctactattgagatactttaagaatcctgtgagttgtgtacctggaaatataaaattgatattattattaatccattcagaaatcatattgggcaatagcactactacatgtacatttagtagcaaacatagatagaatatttggagataatgaagatttcaatactgtgttaagaaaaaaaaaaaaaacaaccacgcaagagactcggctcttggctctcagctccaaagcatgtgaaatattcaacttaataagaacataactgcaggaagcacttctaggtcatgggagttgctatgcacaaaagaggtatggttgttctagctcagagaagcttccacatatattatttattgaggaagcctcattttaatgctgtatagagaagcccgaatgacatactcttcacaagtggcagtattggtattacagcattccaagggtgtgagacttagtttggaaatgaactgagaaaaagcaaataatatttcttaactattgtagaaaatggaggtgtcgctaggaaaattatattttcctctggtctttctcaccatttatttattccgctcaccaaggaccctggcttttgaggagaggtccatggctgagagaacattaaaaggaaagagtgaaagtggagaatgcagatgcatatttggattcaggaggaaggggaggttcaacaggtgccttctatagcagagttggttgttaagtcacactacccacaacatgctacccacaataaccacagaagaaaggttacacatacataggtctgttctcccttttatgctcacttaccacacaaatgacatctttgtgcctgttgttcggggtcattgcctaaaaaagttgagttgaaactggcaatgaagaaagaatgggccgggcatggtggctcacgcctgtaatcccaacactttgagaggccaaggcgggcggatcacctgaggtcaggagttcaagaccagcctggccaacatggtgaaaccccgtctctactaaaaatacaaaaaatcagccgggcgtggtggtgtgcctgtaatcccaactactcgggaggctgaggcaggagaattgcttgaacctgggaggtggaggttgcagtgagccaagatcgcgccattgcactccagactgggcaacgagagtgaaaatccgtctcaaaaaaaaaaaaaaaaaaaaaaggaaagaaaaacacagaaagagtggaggactttaacatttcttgagtacctattgttttcctggcatgttctaggtgtcatatgtacagcatctcattgcatcttcacaacattcctgagcattaggttttcttttcccaggtttacaggggaagaaatggaagattagagaagttaagtagcttgggcaaggtcgcagctggtgaatggctgaatcagaatctgaacaccagtttgtctaattctatcctgcatgctatttccttacaatgttccctttcacttaggggctcatgcaaaagatttatgatttccttcagattttctttggtcatagtgctctaaacacttgtagctgaatttttagttcttacctcaaataagtctgataacactactacatttttaaaaaatgagtgatataatttgtagaaatagtcactggaatgcttttaagagatttcaaatcatagagttgaaaattcatgctgtgctctaggcattattgatcctgagccatctcatgcaggtagatataaatcctcttcttaaagatctctggtgaaaaaacactttcaggcttttccatagtaatttacctcattgctgaaaatgtttacagataggtgtatgcacattgttaggaccaatgacataatgcccagttgcagtgaatcaagctaataaaataataatcctttttaaaattataatcttcaaagggtttccgaaaatcacttataggaagtttatgtgattttgctgtttctctaggaaaggcagttacgtttgaatatttaaatgatcaggccttgtgtgggtcacacagggatttttattttgcatttggattccctttatggtttaaatcacagatctctaccttaaatgcaaatgaatggagtgttgagaattgacataattttttaaattgccatagttatttccagggagctttatacctcagtataagtatcttatcctgtattataattgcttgcttgtttgtccttctaacaagaccatgagcaattggaggacaaggattgtgccttactcatcacagtatctctagtgtttagcataatgcttgacacacaggagtgatcaatagttatctattgagtgactgaattaatttctccaattgattctgcttagacaggcctttctcctacattcccccaaatgcaacctgctaattcacatttctctatcctggtttatgttatttctctcaactggagtgctctttccttcttttctccacttatataagtccacctagttcttcctggtacaactagttgctacatgagtcctgttctaactattccagatctcatagagtcatgtcctcctcatgccttgactcttttagcctatgggatgccccacacactttagccctttattatgtgcagctttatattatttgccaatttaaaaaatatttttgtcttgttttcccaaccattatgaaaagtagccatgtgttgtatcattttctctccccttcatagtgacttaagtgtggaagagaccgttggataacaaactatggcctataagccaaatccagtccaaaacctaagaatatttcttttttaaaaaattaattaattaattaatttatttttgagacagagtcttgctgtgtcgcccaggctggagtgcaatggcgtaatctctgctcactgcaacctccgccccctggactcaagtgattctcctgcctcagcctcctgagtagctgggattacagacgcccgccaccatgccctgctaactttttgcatttttagtagagacggggtttcaccgtgttggtcaggcttggtcttgaactcctgacctcgtgatctgcccgccttggcctcccaaagtgctggcattataggtgtgagccaccacgcccagcaagaatatttcttatgattttaaatggtaagaaaacaatcacaagggctgggtgtagtggctcacgcctgtaatcccaacattttgggaggccgaggtaggtggatcacttgaggtcaggagttcgagaccagcctggccaacatggtgaaacctgtctgtactaaaaatacaaaaattagccaggcgtggtaccaggttcctgtagtcccagctactcaggaggctgaggcaggaaaatcacttgaacccaggagacagaggttgcagtgagcagagatcatgccactgcactctagcctaggcggcaaagggagactgtctcaaaaaccacaagaaaaacaatattttgtgacatgaaaattatatgaaattcaactctccataaataaagttttttgcaacattgccacgtttattcatttacacattatttatgcctgcttttgggctacagcagtagagttgagcaattgtgacagagactctgtggcccacaaagcctaaaatatttactatctgaccctttacagggaaagtttgccgactgctggagtagatcatcaatgagtacttactggttaaataattcattgtcttatgactctattctattatgaaacaagatagtctgaaagtactgttaattatgctgtcttgccttacataaagaaaaatagtaataaaagcaacctctggagaacagattatttttatcttttagttggtgaagtataaaaattttcattttctcattctctggtaaagtgacttatagtgcccttattagttttaaaccttttcaaatatgcagaacctcttcctgcagagattttaaagaacagggtaaggccaggcatggtggcttatgcctgtaatcccagcactttgggaggccgaggcgggtagatcacctgaggtgaggagttcgagaccagcctggctgacatggtgaaaccctgtctctactaaaaatacaaaacattagccgggtgtggtggcgggtgcctgtaatcccagctactcgagaggctgagacaggagaatccctcgaacccaagagacagaggttgcagtgagcagagatcgtgccactgcactccagcctgagtgacagagcatgactccatctcaaaaaaaaaaaaaattaataatagtaataataaagaacagggtagatgattatcgttctgggatggactagataacttctagtattgtgcagcccagtgattccttgaatctcctctaaatgtaaaccttgctttattagaaatgagaaatctgatttgtggatatgaagtctccgcatcccccataactccttgattctcctttgccaggacctccccccaccctccacttttggtttaatctagttcttctaattaaatatgagataattaaagttcacagagtttaaacccagcaggtttgatttaatgataaaaatcttggtttgtcagcttttcaaggcataatcctggctgctgccttatctgacaggtagtcagcctagcaggtctgaggatgaaaaccagagcatctcatcttttcaggcatgacttgctatttatcttctgaggcataatttacaattgccctatagaaaatgggtagggttaaataagtagaaaaggtctccttttgctttggctcaattaattcatttcctatgcggttgtcgatgactaggcttacaaagtagacagatgtatttcaaatgaggagaaaatgccccaaacatagcatatttgattattgtaaattattcctttactcactgaatatgtaaagtatgtaaatttagtcctgctgtcaaaaggtagctctgtaccattagtttctgcagcagacaaggcctgctgcatcctgtactgcattttcagagagataattctaatgacagcttgagcaattgccttaatgagccagaaaggtgttcttttttattcgtgtttagctgcttagagtcatctgaaatagagatcatctgtagatattacagagtgaaaaaagacatgggttatcttattaatgtgtttctccaagcatgctaagaatgaaccatcaatcaggtatttgccaagaaaatagcttgttgtcagttctgtataggtgatatggcaacctgaaatgcaagtttaggttctaattatcatgctagctaagtaaaagagttgtcaagttgcatctataagtcattttgggaaatattgtagggcttaccaaattgatcacaaaatagcattaatattgtaaacctgaagtgaacaacataaccagttttttaaaaataaggcactctacttgagtcatcaggaaaacattagaaatctacctatgtgcatcatattatatgtaaaatttagtttaattggagctttgtgttgttagaacccaacacattaatattaacatttgagacaaatttcctatcatctgagtctttcattctaagtgaaatgtccatattttctcattaatttgggtctatttaaagatcagtcacatcacagtaacataaagattggaaaagtaatgttcacattttagttaaagtcatgaaatatatacctataattgactatggtgttttgatttggttataaagtatagctgtaccttccacacggagttaagagaagtcctggcttaacacattagtggtagaaagtgtaagtttacacttaagccactccccagccaaggatttgcataaaaaatgagtgaagttcagcttgggtttatgttagcaaaatggcaaatgtagaggcacgctaaaggtcctttctgccacccttgtatacaatacatgtctgcatcttgcctaatcttaattaaatgtctttattaaatctttattaaattaataaaatgtcttctgggtctgaggactgaaattctgaaatgtaaccaatatttaagagcttaaacagtgcttctgtatagaacttgtagtatgaaatatgacttcaaaaaagcctgagctgtagaattaattttttcaattgaatgagtaatactgctttaaaaaatatacatggccgggcgccgtggctcatgcctgtaatcccagcactttgggaggccgaggtagggagttcgagaccaacctgaccaacatgcagaaaccctgtctctacttaaaaaaatacaaaattagccaggtgtggtggcacatgcctgtaatcccagctactcaggaggctgaggcaggagaatcgcttgaagccgggaggtggaggttgtggtgagccgagattgcgccattgcactccagcctgggcaacaagagcaaaactctgtctcaaaaaaaaaaaaaaaaaaaaaaaaatatatatatatatatacacacacacacacacacacacacacacacacacacacacatacacacacacatcctttttatggcctcgtgcagtggctcacccctgtaatcccagcactttgggaggccatggtgggcggatcacctgaggtcaggagttcaagactagcctggccaacatggtgaaaccccatctctactaataatacaaaaatcggccaggcatggtaactggcctctgtaatcccatctacttgggaggctgaggcagggagaattgcttaaacctgggaggtggaggttgcagtgagcagagatcgtgcaactgcactccagcctgggcaacagagtgagactctctcaaaaaatatatataggccgtgtgctgtggctcacacctgtaatcccggcactatgggaggccaaggtgggtggatcacctgaggtcaggagttcgagaccagcctgaccaacatggtgaaacccgtctgtactaaaaatacaaaaattagccaggagtcccagctactctggaggctgaggcaggagaatggcttgagcctgggaggcagaggttgcagtgagccaagattgtgccattgcactccaacctgggtgacagagcaagactccgtctaaaaaaaaatctatctatctatctatatatatatatgtgtgtgtgtgtgtatacatgtatatatatacacacatcctttttagtttaaataatccattgtattagaaagaaaaagttacactagtgaatcagctctacagttttcagaaggtgaatcaaataattactaaattgaagtacagtaagatgaactatcatgtgaaattatatttccctataaatttcttatgaaatcttgcattgatttgtgcatgtgtgtttgactaatgaagtgaagtgtgggactactatagaatttagatttaatgcctaggtaatgggtacttgtccaattacaggtcttcatgaagtttctaatgaaaaaaacactaaagagctcttcttctcagctgtatcataaatgacaaaaatctcagctccccaggcctaagtcagtaataagtggaagagtgactcttctagttactaattcatttgtggagttttccaaagttagcttgcattgtaagtttcttataaggaggatcatttcatgagagttggttttttgctattgtcacaattgtgtaatcgtccccatagaagcatgatatgcatacacttaacacattcaatttgtaattcttcttgctagtaaagccaaaaattctatcccatgcttagacatccatggaggtgatcattataatgcattatttgtcaaattttattctttttcaaaactccaaagaaaatgtgacattctactatgtctttgaatctctgattatatacatttgtttatgttaatctataacatgttacttggtttctttgaagctctgttttctagttgatgatgctaaaatttatgttaattcacatctaggtgtacttgaaatcacctaatttgaaattgcagttcttaaacagctctaagaaatataattatgtaaagaatattttgaatgaaattttgaataaattggtagaaacatagttaattgttcgctgcatcccaaaacagtaggcttggaaagtgatgcttttctactttaattttaaatcttgtacattttataagaaaggagtaagcctatccccatattaggcaagtcagattaaatgttagttccattaattcagagaaaataagctcagttaatgatgattcaatgccagttgaaaaataaacagatatgcaaaatcttggtttcttcctgtaatttcttaccatttttttcagtttctttgttgttctgttaaatctttagttaggttatggtagaatgccgtggtacctcattgttctttaactctagtgattggttgtttttaattacattaatggtagttttttgttttttttgtttgttaattttttggtatatcaaacattttctgttaaaggagaaaggaaagaagagctttgacttacaaactgacttgaaagctattccagcaattggttgtctttgaagtaggcaatttaccctttttttcccttcaaaatcagttatactacatatttcctttttgaagcaggaaagaatgaactgtgcatcacagttctgttatctatagcaaatctgtaactcctgaatcctttcttcccgaccccacccaccctgggggctacttctctaccattagtttatggtcatcagagaattacaacaagtagagcagcacagccttgtgctttctactctaaaggtattgcttccccagacaactgaaacttgagttaagcccatgccccaggaaaagaaaggtcaggaagttattttgctttctggaaggctacagagatgagagcaaaggagatgaagagccttggcatctactccagaattgcttttgactgccagacttcgatctaatctctatggcacatcatcagcattcactgtgtacctcatacacaaaagcagaagagtagctggatttctttaaaattgtgcccttcatttgtttcccttgcatgttctatttccccaattaactttgtgagccctgggcaaattagttaacctcactgggcctcaaaggcctcatctataaaatgaatggtttagaatagatgatctttgatcccttccattgcaagcattctatgctgtgaaacctcaaggctgtaaactatatgagagtaggagccaatttttttttttatcattttttttatctccccacagggcctaatgtaactttgactgtactaccttgctttcactatgtgaagtagattttgaagacagctctaatatgtactaaactcgattagaaattagacatcccattttagttgaaagtcagcttattaggtagatgttatatgaacttgcttatttcaaaaggaaaaaaaattctgggaaatgaatcattgggatggaattaagtaatcccatttaggaaaatagtactttaataataggctatgaaagagttatgggttgaattgtcacccaaaaaggtatgtttaagtcctaatccccagtatctgtgaataggaccttgtttgtgattggaggctttgaaaatgtaatcaagttaagatatggtcatactggatgagggtgcaccctaaatccaatgactggtgtccttataagtaggccatgtgggacacaaagacacacagggagaatgccacgtaactgtggaagcatagactggagtgatgcgactgccaaggaatcccaaggattgatggctaccataaaaagctaggagagagaagtgcaacaaattctccatcagaaccttcaaaagaaccaaccctgccctgtaccttaacttcagaattcttgtgtccagagctgtgagagaatacatttctgttattgtaagtcacccagtctgtcataatttattatggcagacctaggaaactaatacagaagatgtggacactggcctaggaaaagtccccaaagaatacataaagctctggactggaacagtcatagcttgcaactaccgtaggacatctactttcagcctaggatgtcttcatattttataaaatataaatctagatagtaatagaacattaagatctttggagcaactcaccattccttacgagatcaggaccgatcttatacaaaccctgatcagctgaattaggatcacatttgttataattattaccgatcccttgagagccacctttgacccagcatatcatacccacaagcctaagagtaagctgcagaaagactgtttcttagaatggttgtccattattgactaccctcttctaccttatgcatgtttcttttgtccttttttcgttaaccatttataaagttagatgctaaagaatattgagctcagaaatagtatttccaaataaacaatgtgtaaatcaatttaagctgtttacttccccattgggaataatctctcttactttctacctatgaaaacttcacccaggctttcaccatgcatagctcagatcccatctacctcatcaaggcttcgttgaattccccatttgaaagtaatctgcttgctgtaattacataacttatactctctatgtagttctgttgacacttagcaaaaagtaccctatattatagttttgtttttacatctctgtgttttattgttaaagaaaaaattattctgacacttgttaaatatggtaaggctgacttcattcagagggactactacagtggaattttgtagtacggtagtgagattaagccaaactccacacacaagaagtaccaagtggacatttatagccatgaaccagggtgggggtcgattgatggaaaattactaagaggaaacatcaggcctaagggcattccagctaaactgacttgacaggattcttgctgaagtcagaccaagatgataagatatccagagtgaggaataaggaatttgatcagataatcaagggtgagggatctgcactaaactaacccagtagtatttttgctaaaacaggactaaatgagccagggacagagcctaagtttgggtctagttaaaaagggagctcagaagaatctgactcaagtttggtcaaaggagagagtctgtcattatctcctcaatgagattctagagaataggaattataattcatactcttttgtatctctactccctactgcccccacccccatgaaaaacagtgtatgcatgtcataaagtagtttgtaattgagtatttttcattgatggttgactaattttgacagagccgacaccttaattcaccagttaaattggctctaggcacagccttgcacaactcatcattatttgactaaatgaagacaatatattctaagactctggtacagaatttctggttaacagtggttggcataatttattctcttgcctgccattttcaagtgatgttactgctttgaactcattttttaaagtaatatttataaatataactggtaaaagtgtggcatctttggccaatgaaaagaattgctgtcagcttgagaaaagaaacgtaaagcactaagtatactagaaattgcagacatcctcacaaaagtgatggattaatgaccacatacagcattatgaaagctagttatggtttgcttaaaccagtctctctctttatggcattctcaatctttttaaacagctaggatataataacattttaaaaattaaagtatttcacataaccaagaacttgatatgaaatgagcaacattaagcacaaaacaattgaagcttcaaatactggagcaggcaagaattttaaacagcccgaatgaataaggatgcaacattgttgtgcttcttcagatgcaggaataatcaggctcagaggttagcagaaagagattttatagcaataatggctccccataccatttttctcttgtgactttgactcacaaaggtgaagctttcatttgaagatttgatacaatgcagctgccaacagcaggggggagaatttggccaaatggctggactctctcaaacatctgtgagggacagagattgagagggagagacagggagaaattgagagagatataaaaggaaaagaggaggggaccaaaaagaaaaaaaaaaaaaaagatttgcattaccaatgacaaatcaaagttgaaagtttgcctttcctgttgtcattcattgccattcatatttagaaagcagactgctgtgataattgatttgatggtccagcttgagtggaagcacttctgggcatagcagcctcagagatgccaaaaaagaagaaaaggtgggaatgaaataatgcactactttctcctcagaggcatgtggcccagtttttaagagcagaaaaacatgctctggggtggggggagtagaaacctaaagaacttagtaataaatacaaaaatgaccatatagctccagtcagataaaaataggcattcaaaccaagacaatgagaggacatattttactgacaagtgaataataggggagtgtggtggaaataatctgatttttaacagactctgtcctttgggagtaccttttttgctcttcttttatatagagacaaaagtgatttcttttctaaaaagccttttaatttttaagcttttcatactagattgatagttcagaaggagaaaaagaaaacaataattgagactgaaaagctatatatgtgcccggattatgtaaacatcactgaatttccttgaagcaataggtaataatgaagcttgtccttagatttgtgagtagaggttggtgttcagccattgcttcctgctgatatgaataagttaggaaactaaagtgccagttgaagggggcaaaagagagagagagagaaagagttttttaaagtactgaattcactgcctgacctcttaatcacaactgccaattggattgtatgccctgtcattccatttaagaacctaaacaaaccagataaaagacatagctgtcaaaacacaaattttaatcagaacctgtttgtcttttgagagaaatatacttgtgttcaaaagtagatcagtcctttaactttgttacctttctctcttttcttccctctcccttctatcttcagttctcctttcttcatttacgtacctagctagctgcctctacttatacctacagagaaagcctgttgtttggcctcattgaatgtgtcatacatatgcagctgttatgcaaatatcaataccgtcccatcacaatttctgttttcctggtaaggttctcaactacagtgagacattaaattttctgagttaaaacaacaacagcaacaaccaaaaccctcaaatgtatgacttatttttaaaagattcatccaaaattaatatggaggaaacagtgttagctgtcagtataatgtatgacagtatttctgaaaatcttttaaaaaaatcatgagaattacctgggaaacttactaaaattcattatacaatgtatacctatatcaaaacatcacgttgtaccccataaatatatatagttattatatatcaatcataaattgtttaaaaatttagagtatcagaccataccccaggtcttgaatcacagtatatagtgctcaggaatctacattttaacaagtgcccagatcatttttctacatactactgaagtttgaataccagagacataatagttaaagagcaatatttaattacatcaactggaatctaattccgtttttaccattactagttgtgtaaacttaggcaaattatctagcctttctaaaacttagtttcttcatccatgaaatgtatgtaacaatgcctacctaatagggttattctgagaattaaataacataacgaatataaaacacagcacagtagctggtgattctaatatcaatacatagtcaatattattgatattgtttatcttttatgatttagaaataggttcttttctatgggttgttcatattgcgcccttgtaaataatagtttctatttccattttatattaacatagacggtacttttccatgtctcaaggatgtataagattaaacatcaggccaggtgtggtggctcatgcctgtaatcccagcactttgggaggccgaggcgggcagatcacgatgtcaggagatcgagaccatcctggctaacacggtgaaaccccatctctactaaaaatacaaaaattagccaggcgtggtggcacgtgcctgtagtcccagctactcaggaggctgaggcaggagaatcacttgaacctgggaggcggaggttgcggtgagcgatatcacgccactgcactccagcctggtgacagagcgagaaaaaaaaaagaaaagaaaagattaaatatcatccccatcacttcatcttacccagtggggaaacaaactattttaaactaaagtagtagcacatgcttactggcatagagcagaacattcttattaataccaactctatgtaaataactagatatatacattattcacatctgaatgtgtaattaaagaccatttaggtactgaacttgatgaatgagagggaaaaatgtctgggatgtcaatgtgatactgtaaataccgaaggcaattcacagtgtgactagtagcaccacctgtctcacacccaaagataattcatcaaataataccacgtctaaactggcagattctttgtcttcatagcctaaaatagagaaaagatcactagattttttttttaaaaatctaatcccaaaacttaccagctctgttacttcagacaaacctcttaaccctcagtgcccccatctataaaataaggataattatatttgccccacctcacagccttgaagtgaaaagaaatgtggtaatgtatccaggaagcatttataaactaaatgctatacaaacaaatggtgttatttcatacctattcaaatggactgaaagtcatttgaaaatgttatcaacttttgaccgtgattgtattctcattttccaaggaagtccaaaagatagattaaatttgaattcttcattgttgtgccttgctgatttttgcttgaggtgatcacactgcattgatgcatttttacacagcttttgttgaatattccttggtccaaaagctttcagctttatggctttgaagctccaattccctgatcaatgtctgaacttgtgaagcttgaaatttgtcatttggcattgacttatgtgtaaatctgagtcaaaattcagtgtcctttaaacatctcggggcaaattttcagcatggcctcatttttactgatatgatcatgtatttgtaagtacagattgccacttttgtcctcaagagagcacaaagtggtcattgcacctgccatgaggtaattgaaggtgcaaaaaatcccacttctacaaaaaagtctttataacactcccttcctttacacccctcccttctgttcctctgtgtgtaccgaaaataaaaaaaaaaaaagaaataatgctattagcaggctatgaatagagatcagcatttcttttcaagaaaaataaactgcatttaatttgggcttctcttaaaaaaataagatacccggtgtaatttaaaataaaaatattgatggaaatggcaatgtctttcataattattattcaattgcaatgttatatactccataacttaagcaaatgagtagttttgactactggaaaatagcatttgaaagtcaattatggaacttccagcacacctatagttttagtgtcctaaacttatcctctaaagttactctagaccaaaagagtaacatttgtttttgatacacccttctttgtgccagtgttctctaagtactttttggattctcgtgctagagaaaaagagctataagaaatgaaagataaacctaacctagggttttatctgttaccagaacagtatatatgttacaaatgacttataaaattacccaggcagtgggagcacttcctagccatttcctggtgtgctacctgtggccattctaagcattgactaaaaattattcacagaccttgattttattgctagtgatatatttacacatactatttagcccagattattcatatactacatatatgcctactagcccagtgcaagtaggtagtcacttgtttacctctcagaaacagcaagctgttatttttcctttttaaaaatttggctatatttgttttttggttgtaggaagaaaacttaacaagagatctaccctcttatcaaatctttaagtgcacaatacaatattgttaactataggcactatgccatacaatagatctctagaatttattcatcttgcacaaatgaaactttatacctgttgaacagcaactccccactcctccttctccccagaccctggcaaccaccattctactctgtttctgtgagtttaactattttaaatagctcataaacgtggaatcccgcagtatgagtctttgtgtgcctgtcttacttcacttagcatatgtctccaggttcaaccatgttgtcacatatggcaggatttctttctgtgtttaaggctgaatcatattccattgtacgtacataccacattttctccatttactctattcattcactgatggacatttggattatttccctatcttggctgttgtgaataatgctgcagtgaacatgggagtgcagatatcaatttgagatcctgctgtcaattcttttttttgttttttttgttttgagacagagtctcgctctgtcacccatgctggagtgcagtggcgtgatctcggttcactgtaacctccacctcctgagttcaagcaattctcctgcctcagcctcctgagtagctgggattacaggcacgtgccaccacgcccggctcattttttgtatctttagtagagacggggtttcaccatgttagccaggatggtcttgatctcctgacctcgtgatccgcctgccttgacctcccaaagttttgggattacaggcatgagccaccgcgcccggcctcaattctttcggacatatccccagaagagggattactggatcttctggtaagtctgtttttaattttttgaggaagcttcatactcttttccataatggctgcatcattttacattcccactaacagttgtataagggttccaatttcttcacatccttaacagtgcttgttaccttttcacatccttaacaatgccttttacattttttttttgttgttaaatagtagacatcctaactggggtgaggtgacatctcattgtagtttttgatttgcatttccttgattagtgatgttgagcatcttttcacatacctgttggccatttgtatgtctactttggagaaatgtctattcaaaacctttccttattttttaaactggctatttgggagcttttttgttttttattttgttttgtttcattttgtttttgagatggcgtttcgcccttgttacccaagctggagtgcaatggcacaatcttggctcaccacaacctccacctcccgggttcaagcgattcttctgcctcagcctcccgagtagctgggattacaggcctgcaccaccatgcctagttaattttgtatttttattagagatggggtttctccatgttggtcaggctggtcttgaactcccaacctcaggtgatctgcctgcctcggcctcccaaagtgctgaaattacaggcatgagccaccatacccagctgttttgtttttttgatcttgagttatttgagttccttacgtatttgacacattttgcatagttagccctttatcagatatgcagctagcaaatattttctctcatttttgtaaattgccttttcattttgattgcttgctgtacagaagctttttagttttatgtaatctcactgtgtttttgcttttgctgcttatgcttttggtgtcatatccaagaaatcattgcccagaccaataccatgatgcttttcccctttgttttcttcaaggagttttgtaggtttaggtcttacgtttaaatctttaacccatttttagttgatttttatatataatgtgggatgaaggtccaatttcattcttttgcatgtccatatccaattttcccactaccatttgttgaagagactttccttttctcattctgtgttcttggcaccccatacaaagatcagttgaccatatatgcatggatatatttctaggctctctattctgtttccttggtctacatgtctgtttttatgtcagtcccatattttttaaattgctgaaggtttgtaatatattttaaaataaggaagtgtggcgaatccagctatgttcttctttctcaagatttctttggctattcatgctcttttgtagttatgaattttacgatgggtttttctatttctctgaaaaatgccattgggacatttaaagggattgcattgaatctatagattatcttaagtagtatggacattttaacaatattaagtctttcactgaatatcttttcatttatatatgttgtctttaatttgtttcatcaacgttatgtagttttcgccgtacaagtctttcacctccttggttaaatgtattcctaagtatttcattctttgtgatactatgcaaatgggattgctttctcagttttgttttcagtactttattgttaatgtacagaaatgcaattgatttttgtatgttgattttgtatcgtgcaactttgctgaattttttaattagttttaacagttttttgtggaatatttagggttttctctatgtaagatcacgtgtcggcaaacagagatagttttacttcttttttttttcctcccaattttaatgtcttttatttttctttttcttgtctagttgctccagctagagcttccagtactatcttgaatataaatggtgagggtgggcattctttccatttcctgatatgagaagaaaaactttgtgttttatcattagtttgatattagcagtgggcttttcatatatggccttaattgtgttgaggtaaattccttgtatgtctaatttattgatagtgtttatcatggaaaggtgttgaattttttcaaatgctttttctgcatctattgggatgattgtgtgatttttatccttcattctattaatgtggtgtagcacattaattgatttgcatatgttcaagccatcctcacatattagggataagtcccatttgatcatgatgtatgattttttagaacttagtgttgaattcggtttgctaatattttcttgggaattttcacatctgttttcatcgaagatactggtctgtagttttcttgtagtgtctgtgactttgtattagggtaatactggcttgattgaatgagtttcgaagtctactctcttaaagtctttaaaaagtgttggggttaattcttcattaaatatttgataaaattcaccactgacaccatctaatgctggatttttctttttgcagagggttttgattactgattcagtctccttgtttgttattggtctgtttagattttccatttcatcatgatttacccttggtaggttgtatatttctgtgaatataaccattgcttcgagattatccaatttgttggtgtataattcttcatagtagtctcttctgatcctgtttatttctgtggcatcagttctaatgtctcatctttcatttctgattttgaatcttttttttttttttagtataaggatttttccattttgtttatattttcagaaaaaaacaattttctgtttcactgattttttttctactgcttttctgttctctatttcatttattttgactctagtctttgttatttccttgcttctgctaatgttgggcttctcctaaatttgttctttttctggctccttgaggtataacattagattgtttatttgagatctttctacttttttaatgtaggcattttatcaccataaatatccctcttagaattgcttttgctctatctcgtaagttttgttatgttgtattttcatttttgcatgtcttaagatattttctaattttttttttaatttcttcattggcccattggtttttaaagagtgtgttgtttcatttccacatatttgtaaattatccaattttccttctgctattaatttctagtttcattccactatagtcagaaaagatactgtgtaggatttcagtcttaaattcgttgagactttttttgtgacttaacacgtgatatattctggagaatgttccatgtgtgcatgagaagaatgtgtatttcacaactgttggttgaaatgtcttctgtatgtcttttagttcctcttgctcttagtgttgttcaagtctattgtttccttattgatttttttttttgcctggatgttctattcattatcaaaagtgggatatgaattatcttaccaataccatagtgctgtctgtttcctacttcagatctgtcagtgtttactttgtatatttagatgctctaatatttggtgtatatatggatttataattgttatatcttcctgatgaattgctttcattattatgtaatgacctttttcgcctctatgtcggtttttgacttatagtctattttgtgtcacataaagtatagccactcctgctctcttttggttaccatttgtgtggaatatctttttctgtctctttactttcaggctatgtgtgtcctcaaagctaagtgttgtctcttataggtagcatataattagatattgtttatttatctattctgccactctgtgtcttttgtttggggagtttaatccatttgcatttatttatttattttattttttttgagacagagtcttgttctgttgcccaggctggagtgcagtggtgcgatctcggctcatggcagcctccgcctcctgggttcaagtgattctcctgtctcagcctcccaagtagctgggactacaggcgtgcaccaccacacccggctaatttttgtatttttagtacagacagggtttcaccatgttgcccaggatggtctcgatctcctgacctcatgatccacccaaagtgctgggattacaggcgtgagccaccgcaccaggcctccatttacatttcaagtaattattgatagggaaggacttactattgcccttttgttgattgttttctgtttcatagtctttttgtccctgttttcctctcttgctatcttcttttgtgatttgttgattttttgtagtgatatgctttggttccttcttctatttcttttgtgtatcttctatagttaatttctttatgattaccatgaagcttgcatagattgtcttacagttacagcagttctatattaagctgctgacaacttaactgcactcacatacaaaaaccttccacttttacttctccctcaccatactctgttattgatgtcatagtttaaatctttttatattgtgtatccattaacaaatttgtgtagttataatcttaatatttttgtcttttaactttaatagtagagtttaaagttatttacagtccaccattattgtagtatccgggctgggcacagtggcttctaatcccagcacttcaggaggccaaagtgggcaaattcattgagtctaggaattcaagaccagcctgggcaacatggcaaaaccctgtctctattaaaaatgcaaaaaattagccaggcatggtggtgcacaattatattcccagcttctcaggaagctgaggtgggagaatcagccgaggctgcagtgagctgtgatcatgccactgcagtctagcctaggcaataggaatgagaccctgtctcaaaaaaaattatctatgtctatatctatattatatatatatagtattctgtgtttgtctgtatgcttgcccataccagtgtgttgtattctttcatatgcttttgtgttactgttttagcatctgttcatttctactggaagaactcccgttagcatcatgtctagtggtgatgaactcccgtgccttttgtttggaaaagtctttatctcaccttcacttttgaaggacaattttgccagatatagtattcttgattggcatttttttttctttcaacactttgaatattataagctcactgccttctggtctgcaaggtttctgctaagaaatccactgatagtcttattgaggactcactttacatcacgagtcacttttctcttgctcctttaaaatttttctttgactttgtgcaatttgattatattgtatctcagtgtagacttctttgggtttgtctaatttggcattctttgggcttcatgaatctggatatccatttccttgcccagatttgaaatgttttcctccatgagttctttatataagctttttcccctgactatctctcttctcctttgagattcccataatgaatgtattggtctgcttgatgatgttcagtaagtagcttaggctttcttcattctttatcattctttgctttttgctcctctggctacataatttggatgacttgtcttcagtttcactgattccttctgcttaatcaagtctgctgtttaatcactgtagtgatttttcagttcagtcactgaaccagaatttctgtttggttatttttatttatttatttatttatttattcatttatttattcatttatttattgagacggagtttcactcttgttgcccaggctggagtgcaatggcacaatctcggctcactgcaacctctgcctcccgggttcaagctattctcctgcctcagcctcctgagtagctgggattacaggcatgcgccaccatgcctggctaattttttatttttagtagagacggggtttctccatgttagtcaggctggtctcaaactcccaacctcaggtgatctgcctgcctcagcctcccaaactgctgggattacaggcgtgagccaccgcacccggcctggttatttttttttaaataatttctacctctgttagggccagatgtggtggctcatgtctgtaatccagcactttgggaggccaaggcaggtggatcacttgaggtcaggagatcgagaccagcctggccaacgtgatgagacaccatctctactaaaaaaaaaaattacaaaaattagccagttgtggttgcacatacctgtaatcccagctactggggaggctgaggcaggagaatctcttgagcctgggaggcaaaggttgcaatgagcccgagattgtgccactgcactctagtctgggtgacagagtgggactccatctcaaaaaaaaagaaaaaggcaactcaaacaacaacaaaaaaaccagcctgagctgggcatggtggctcacacctgtaatcccagcactttgggagtctgagatgcgtgaatcacttgaggtcaggagtttgagaccagcctggccaacatagggaaaccccatctctacttgaaaaacatatttatatatatgtatgtatatatttgtgtgtatatatatatatttatatatatgtatatatttgtgtgtgtgtatatatgtatacacacacacacacagaaaaattagccgggcatggtgtcccatgtctgtagtcccagctactcgggatgctgaggcaggagaatctctttaaccagggaggcggaggttgcagtgagctgagattgtgctgctgcacttcagcctgggcaacagagcgagactctgtctcaataaataaataaatacatacataatttctacctctgttgacattctcattttgttgctgaattattttcttaatgttgttcagttgtctatattctcttgtaactcactgagcttccttaagatgattattttgaaatctttgttagcctattcatagatctccatttctttagagttgtgtattacgatttaatttgttcctttagtgtaatgtttcactgatttttcttgtttcttatacttttgcactggtgtctgcacatttgaggaagcagccacccttcccattctttctggacttgtttagacatggaaagagcttaaccaattcactaggctagagattctaggagcctctcaaaccttttctatgaatgtgtcttctctggatttgtgtgggaggattcctaattagatggatttacccctagcacaattcatagagccatgctaatgtcttctgaggcaggacagaatccagcccgaccctggtggttcactgaggccagattgttgggaacatgttccatttctctcctatcacagtggaagaagcatcaggctctgtgccttctctcaatcttgtagagctatgctcaccacagtaagctgcctgccctttttcctttgttcttaattgccctgaaacatccaagctatttcttttctatcagtgtcccatgtgaggtgagatagaaactagcccttcaggcagtgcaccaaaaggctggtacattggaagcattctctactctgtattttcccctgagaaagaaactgtgggccaaagtgatatttttcagtgctgagctgtgatggcttgggggaaggggctaatactagtaaagtgaaattgctccttactcatttcagtagagttttttcagttttgtgtttctctggtgtactgcaacctcttaaaaggattctggtcttctcataaaggtattgtggtctacattgttaagttggtgtttctatgggagaacaagagatggaactttctatttcaccattttgatgatatcagcaagctattatttaaatgagaagtttcctttacttagatgagcaatataatttaatgcaagtttgtctatggatttctccttgagtgactacattacaaaaggccatctggaattccctttctacacatcactgttaaagcaaaaaactatatttaagtggtaccaaggtatcaggattccctgcagacagtttgagatctaatataaaatcaaaaaccccttataggccactggtctaaatgatgacagtaaaaaattcccaagactattaagttttattaatgaatatgatggaaaataagatcttggaatgtgaattaaatgtttttaaggtgatgagtgggtaagaaagagaggtgataaaagtttttgaaaacttgttttcaaagcaatactattacatattaaatatacagtttaaacttttctcatcctgctgacaaatacatacctgagccaagattactgttttgtttcattttaaccattcccctacatggtaatatctatagtgaatgaccatttctggagagttttactttgatatgttagcacatcattacctgttaggtagccccaaaatgtaaataaattatacctcattccatattgtcaaaacatagaaacagcaacaaagatacctaaatgaaagaagctgtgattgtttttcaaaaccaaagaagagaagtgtaagaaaagcattgaatttaaggggcagaaactatcccagaaagttactgctagaattcaaatactaaagaaagtaatagaattatacctttataaagatcaagggtaacaaatttgaattggtaccttttttttttttttttttttttttgagaaggagtttcgctctcgttgcccaggctggagtgcaatggcgcgatcttggctcaccacaacctccatctcccgggctcaagagattctcctccctcagccttctgagtagctgggattacaggcatgtgccaccacgcccagctaattttgtatttttagtagagacagggtttctccatgttagtcaggctggtctcaaactcctgacctcaggtgatccacccacctcggcctcccaaagtgctgggattacaggcgtgagccaccacgcccagcaagtaccattttcattcttaaatttgttcatatgttaaaaaaaaagaaaacataagcatgctttagttttccatcttcacattaggtaacacaatgaatgaatgaatatagttattttctaatactctcacacagattggttcttccatgggtaaatagttctctgtagccctgaattagattttttttttttttttttttccgagacggagttttgctcttgtcaccaaggggggagtgccatagcactcaccatgtctcaccatgttggccaggctagtctcgaactcctgacctcaggtgatccgcccacatcggcctcccaaagtgctgggattataggcatgagccactgcacccagccatgaattagattttgattgatgaaaagggagataataattccaataatcttatgttccataaatgaaattttaaaactgatacatttttatatttaaaaacttcaaaataaatagaaaaatacaactttgagttgtagttttttttagtggtcaatctgatgagcttgggcccgtataaggtatgttggacaagaaaacactatcctaatcaatgttgacttaactgaattcattcagataagtggaaatattgttagatttgttgactggaaggaagtctgagtttgattagtccaaaggtgatttgaggaaaggtggtaagctgaacatgacctcccctgagtattactgaaaggaaggagaatttgaaccaaattttaagatttggccaggaccaaataagatatcattgcagaaaatctgtgctatatgtcaatgacccttcagaaaataaaaagtaaagataaaatggagttggcactccatctctggcctgtgtgtgctgcccccacccccacgcctcccttctgtctctcaagttttgagatcacccctgttaacctcctcttctcttccctggctcagccaatttgtaagctctgatcacatttttttttttttttaccacattctctttgtaccctatcttttgctttcttatagttgcttaatattgtgtaacggaggccaggcacagtggctcatgtctgtaatcccagcactttaggaggccgagtttggcggattacttgaggttaggagttacagaccagcctggccaacatgatgaaaccccatctctactaagaatacaaaaattagcgaggtatattggcacatggctttaatcccagctacttgggaggctgcagcaggagaattgcttgaacccgggagttggaggttgcagtgagccaatatcatgccactggtatattggaagcattctctactctgtcttttcccctaagaaagaaattgcgggccaaagtgtgtaagggaagggttaaaatgagtgagtgagtctctctctctatatgtatatatatatcatataacagtctttttctaattccaaggaatagaggcatgctaaagtttttaaaggtaatatagggttaagaaaatatgaggaagaaatatcacagtggtctcccagccatggctcatcaaaactagaatgttctgactacaacagtggctctggaagtctgacagcacctctgacatattgaccaccctgctggtagtcttcctttaggagcaggtttgtgcttgattccagttgtaacttactaatccttctattcttatgatttgccattatggtgtctcagctactgcatttttatttttctgtctatctaattcttcttttatttccttaacaatgaatgaactctctgttctcctttctatatcagggtatctgcttatttatggtttctactgccatgtggcttttaacatcctctctctcttagcttctgcttctgcctaacatacatatccgtttctgcatgtgtctcattaagttaccccaagaaaaatttggtttgtttggttcagagcagagattttctgctggaaaaatctctcatggcaatctatagatagttttctttggtacgtactcattatctaatctcttatgattggggtcatacgaaaccaaacattgtgacctatatgtaaagtacctctttagcaggagactctaaggtatctcagaagagagtagtacaacagagatattatttacagaatattctgtatattgagcccttacatcaggagacttgaggtactagatgtttacttttactatatatcattgaatcaaagatagtatcaatcataagatattacattaatttatttaccattgagaaaggaaaagatgctgccaatgaaatcacagcacaccaatgattgttagatgcatctcagtctcagagatgttaaaatgtgaaaaaagtacatttttaaaagatgtaatgtggtgtcagtagcatatctgagattgtctgaggatcaaagcaggtatagtgaacccccagagaagttccctgaggactgactcctagagtggggtaaatgctaaaggttacaggttggattactaatctgacagaccagagggtagtgtctagagactagatagccagctatctgtctgcaagtggagaggaggccagtcactggtccagagtgtggtttgcctcagggacttggcagatatcagaaggtagatccaaggagaaggtgaattattcctgtattgatttaaatgacatgaatatattgggaatttctgtttctcttaattcctcatttgtgttctgggatcaattcagttgtgtctcttatcttctagaatatctccttgtttattacttgtacattaactatatctctggatgtagggtcattttataaaccaaatgctgtattttgtccatgaggcacctaaaatagcacagccagggatagctaagcttacagttgtgatacattaatgaataacctctggttgttgactccctttttgttattgggagagttaatgtagcttttttcaaatttttagattcagcgggtacatgtgcaggtttgttgcataggtatattgaatggtgagatttgggcttctagtgtacttgtcactcaaatagtgaccattgtacttaatagatttggagatttctcagagaactaaaaatagacctaccattcagccctgcagtcccactattgggcatctacccaaagggaaagaaatcattctatgaaaaagacacctgtactcatatgtttattgcagtactactcacaatagcaaagtcatggaatcaacctaaatatccatcaacagttgattggataaagaaaatatggtatatgtacaccatggaatactatgcagccataaaaaagataactttaattataattatgaatcaacatgtctttctttccatttctactatgtaaatagagcagaaatcccacattaatgtgattagcatagaagaaagtcctcactgaattccccttgctctcttaccaactggctggacatggcataggtggttatctaagaatactcccatgaatcttcacagcattcagagatcagtttactctgggtttgttagatatgcgatatgggctagctgtttgttagaaccacatttcccaatgtgtttccactgaacacttattttttctgatgttgctacatgtcttgtgtaaaaagcattgggtaaaagtgctgggtaagttaaagggctctgataactctatataatgtatgtagatttctggctgaatctttgggtgtttactgctcatgggttccactgctattacagcccaacacagctggtatgatttgcaggttggtctcttggggccctttcaccttctgagctctgaaagcctaagataagcaatttttcctttgtccttcaagatgactgtggtctcagcttagactcaagagaactcgtttgaaattgaacaagagcaagcctagctcaagaggatagcaaagtgcctagttttatttgtcactgcactagaaacttcctaaggaataatttttaaaagggggccagttttgtttctgagactcaactagactttcactcatgctctgggggaaggaattcaagtctccaacattgtccttattgtacacctgtagggccagactgattatcctaaattttacatagcctaagaatgagcttagatttcaaaataaaaagctttctctgcttttgcgtagaacatttctatctattatttcagttaatttatccttgttatcaatattgaagtaccgcttgctatacatattctagacatgggtaacaatgtctagaagtacactctgatttcacaacagccattcaaggagatatatatatatatatatatatatatatatatatatatatccttgcaagtgcattctagggctgctgggacatgtgttcttaaatcctcctttgccagttctccaaatatgccaaattgttttgaaatggcattcttgtcttgtcttgttgaatctacacttctattccttccttttgctttttattccaaccttccattttctatcctttaattaaaaagatggctaatatatgggagatgttgtagtccgttgttgtctaaaatgaatttagcagacactcccccaccattccccctccccaagttcagcatcaggaataaaagtctcatcagtccttttggcagcatttaagtgaatggcccccagtggctttatgcttgctaatttgagtactctttttacgtacagagctagtcagattgacagaccacactgtacgaagatatatactagtctttgagtcatagattttgtaaataaactgagaacagtggctgaaaatcagattacctgaaagtctggaaggaaaaaggcatagaatgacctcatctagtctcttttcaaaagcactatatatatttcaaattttagagtttctagagacaattagcaggcagtagttgcaagaataggcagaacccctgtgagatgtataagctgtatgatcttcattaacttatatctaaaagtttaacaaacatatactgacattatttttaaaagacaagtatgttaaggaatttgtcttctacatagtgacaggtatcaaagtgaagaatatggccttttgtttttttcttactatatactaaaatgttgctttatattaaaagatcgtaatttatttccatgaatcaaattctgtacttaaaactgacttctgtttatttatatactgttgtgtgatagaaattctcttgggggaggcaatagaaatattacatgccttttaataaagcgggcttttaaaataatttaattcaacttttcacctcttatgaaatttttgaaaagatattttctaatttattttattttattattttttatttttgagacagagtctcactctgttgcccaggctggagtgcagcatcgtgatctcggctcactgcaacttccgcctcctgggttcaagcaattctcctgcctcagcctcccgagtagctgggattactggcatccaccaccaagcccaactaatttttgtctctttagtagagacagggtttcgccatgttggccaggctggtcccaaactcctgacctcaggtgatccacccaccttggcctcccaaagtgctgggattacaagcgtgagccatcgtgtccagccttatttttttttattttaaatagagctctccaaataatgtctgttttgtattgaaatgaatgaattcatgaacttgctttcttcgcagcatgagggactaacagctagaataaaaataatcaacctaatatttcttgttgctggaaaataattatgagaatattacacagaggaagccatgcttaaaataaaggcttcatattgcatttaaaactcaggcgggactttcaaggattctgtttagtagaataatatattgatgaacccttggagaaccaattatgttgtttcacatgaattacaaatgcatcatttagctgtattatagtcttacatgtgtcctttacaattaatcaccattaaatgttagaaatgtaaaatttaagaggcaaagaaagcatacttctttaacaaagtggcccaaacaaataccagtattttaatttgaggtctgtaacaggtctacagattttattttctcattttgcaagatcagtgtatgaatctgagttcttttaatagatttttcttgcaaaatcttattgttaattgcaaatgtaagttgtgacagtaatttttagtataccactttagacttacttctggaatttgagcaacagaaacatattattagaactttttattatttctgtagctatcttttcaaatatttccaaaacgtatggctttttaagcctttgcctctgcaagtcacaatttcaagtaggcgctgaaattctagtaacgtgagcagtgcaacagtacattgagtcttaccagtaagttttagtgaattatttaggaagtgaacgttgattcccttatgagtcagtccagcctctttctgaaaatagtgttgttcccattatgtgtaccattttgcaggaaaatattgtattccaaggaactgggtgttatcagtaattaagtaggcagaacccatagatattgaatagtttaagttgtaaatgtgataaacttctataatacaaatatttgtggacagaaaatgctgtgagatatggaagcacaaagtagaagtagcatttatgaactgttactaagttccagacattttactaagtgctgaggatactgagataaataagaaataatccctttcctcgggaaattataccagtggtagaaatactccaaagggccaacagtgaaggaatcacaatgaattgacatattatgtactaaatagatctgctcacatcctgaggtctccaggcaaggtttacatgcacttgaactgccctgcataattgctattctgctgacaaaagtataggtgtggtatggtagagctcaaaggactctgagaagtcatatagtccaaatccttcattttccagaagaggagaaccaggcccagagagggtgaagggattttctccaggtcatgtagcaaactaacgacagttgggactataatgcagatttcttgatcctcagtccaatctttcaagtggagataacctcaaacctttttgtttccccattctctactttaagcaatggcacaagaagtccatgggaaaatgaaattccctaaatggggaaaagaggaccttgatagaacgctcatgagatcaataaagaaattaaaggacagggtgaaaaaatgtttaaaagtatgtagggagcacatatagaccagaaagaaaattaagaaaatcccagtggcaaaaataagagaattgcaaagaaagggctgaaataattatccaaaaacaattctttttatgggtaaacaggctaaaatgccataggtctaattttatgcattcaacctgcttcagaattttttttcaaactaaatagtcagctatgttaagtagcctcacattaaatggaagaactctctattatttagcacatttgtatagttgcaacgtagtgatgagtgatgtgtctaatgatggccccaagacagtgtaatgccccaatgtaccttttgagctattgaaaaatatttctattatgttcagcctagttttatttttaactatatttaatattcaaaatcttggaaatgggagctatgtttataatatctctggcaattatctataaatacatctaagttgatcgcagcacttcatatcttagataggctgtatagtagagactttactgtaacgagaaagatcctgaattgttaccctacttgtcttcccagatgttttctttgttaggctttttgggatttctgatttttcttgctctttttcttataaaatgtgaaatatatagcctgtgataatgcttggctgccctgcccaattattgaccaatgtcgatccaattatgcttttaaaagtatatattatgtaaatagattattttaccttctgctgccttataaatctttttttgtacagcagcaagggaagattataatgtcattggctgtcaaaatgcccttttcatgtaagtcagctgccaggcaaggatcctacatctgttttctagcatccatataaatgtctgtgataaataagtcattgctcactggagctgcctttgtgaagcagatcctgtacttactgtttctttcacatgcaaaatgacagcagtcaacctaattgactattacttggtcagtttctgtgtcagaagtgatgccaggtaagtaggagaaatccaaacttaatgcatttctgtttaaacccagaaagatttagtaatagaaaaaacagcaccaatttcaggtttttcagagatgagtgtgttcccaaaggatgaacttgacactactgcattctttctcacaacctaaactggattcttctatgaatctctgagtgaattcttagtagacacattgacatggtataaaatacatcacacggctgtaataaacataggttagaattgtggttcagttttcagccaaatgccaggataccattttcatatgtagtctttcctaattggaaatctagaggatggggtacaaaatagtcatcctaatctgttcaaacatcaatggacaattatgtctctaaaattctcaatactttgcaattaaagagtttttgattcctacattgcagagcaggcctcttcttctgtgactgatgctgccctctcttttctatgtcatctctgctttggaatcatcatcattacggggcatgataccagtcatgttaggccatgctgctgacaatggttactttcaacaagggggagtaaccagggaaaggacatccatcattatgtaatgtaggggaaaaaacccaaagactcagaagccatgttaacaaacacagctggaagcaaggaggcatttgagtaggattacaaacatcttagattgtgcagattagtactagatttagggaaaacatgaattgaacaacctcttttgcacaaatgagcaacctggagtttgcagtaatggagccaatagcctcatcacattttgaatccatttggatgtcatgtaaagaatgaacatatgcagtacttaataaagaaaggtcaattctgccatggtgatcactgaagcataatgcagcaaatgaggtagggcttttttttttttttaactcatcaatcctagaacatttaaatttatcttttcagtaagttgagggatttttttaaatctcctgcatctgttataacctaaatgaacagcagttcaaagccaactccacacctgtactgacatactaaaaatgtcaaataatttgtataaaaatgctgagatgcagtttcactaacagtctgttttgtcagtgtcctccctatttatcagattctaagaggattgttgggttgatgtggctctgtatatttccaattccctcctatttttggattgtactgctttgattatagttaacaaccaaccttgcaagaattcaagatttgtcatagctacaatactttttccacctcatagctttaacagtggcatttgtatgttacccaaaccaaaccactgagttcatcattttcatccaaagaagagtagcttccttgattttcagcataatgtttctggctatctagtgcctttttttttttttttttttttttttttttgagatggagtctcattctgtcgcccaggctggagtgcaatggcgccatcttggctcactgcaacctctgcctcccaggttcaagcaattctcctgtctcagcctccagggtagctgagactacaggcgcacgccatgaagcccggctaatttttgcattttttagtagagatggggtttcaccatattggtcaggctggtctggaactcctgacctcaggtgatccgcccaccttggcccccgaaagtgctgggattagaggcgtcagccaccatgcccagcccttttttttttttttttttttcagatggtaaactaaaaggaaataaaattgtaacctcagctggtgccataattctttcttggcttatagtttctgaaaggtgttgaaacgattacatatttatccatgagttccaaaattgcccctctaattcaagtcattagaaccttcttccacctacaactcatttgaactgtttttcattaaaagtcatgtccaagagtcagttcgagtgtcacgttatttggtcattccagctttcctcctgagtcttgtaaccctgactatcattagtgctgtatatagttctgtccacttgtctccttttcttatccagtagttcttggagggcatcaactatgctatctttgttgttttcacattgcttatacattgtggagattgaatacatttttgatttttaacaaacgttcaatgtgctcttactaaagcttggcaatgacctagatcaggggtttgccaactatggtcagtgggccaaatccagcccatggactagagctaaaatgttgtttatatctttaaagagttgtaaaaacaaagaagaatatacagcagacaccatatgtggcccacaaaggctaaaatatttgccatctggcccttcacaaggaaaatgttgctggcctttcttccagatgctgaggatacaccagtgaacaaaaccgacaaaaaaaaaaaaaaaaaaaaaaaaatccctaccttcagagagcataaattctatttttttacaacaattttatgcagaatacgcatcttatttttgtaaatatgcacaatatttacatatagtacatactcaatatttgtgaaatgaatgaataagtcatagagtccatcatccaatattatataatattggcaaatatttccatatgatgtaataaaatgttgcattttttaaatctttatatgaagaatttttccctagataatttttagaccaaaaactcaaacactacttacttgtcaagacattttattctggtacttagtaatgatttcccatcttaatgtaacttttattcatgatgaggtcctgattatctagcctccttatgagaggtaatcataattatatttgattctgaaagctttctgaaatggtgattctttcataagagatcattttgtatacgtgacagttaaaacaatgagttagtttttcagagtttctatccttgaattctacaagtttgtgatgtttatagcttgaattcagataaaaccattttgctccacatttgaaacgacaaatcttttgcattagactcagagttgactaaaactatggcagcttttcataaagtcaggctatagatgtccctaattcccccacagagcccacagccctttgaaagtgatgatagaatactggggatggatcagagagtgctgagaggagagtggaagggaagaagggacaaagggaaaggaatccagagtgggaagagttggattcgtagagccagcagatggtgttggtgataaagaagattacgtgactcatttctgtaacccatgagtgtcaaagttctccactcagtgccatgtctccatcccattacccccacctaaataagttatctgttctaacacccatctgtccccacaccaaaccatcattaccagcaagcaatttcttgtactgtcctttatcttttaaatattaaaaattagaagtaaatgagatgtgagatctaaaaaaaaaatgacatgaccttttatttatttccactggtcttttaatctaggctgcccttactcctcatagactatacactgcctcttagatactacactgctattagtctaaatactttgctttattatggaactgctcatttcttattccttgcatagatttagggttgataaactgagagtttaaaatgcagtaatggagaatcttaattataaatgaaggaaattgaaacatactactgtatgtgctgatttactttcagattcttgacctttgtcaagactaatgagattacacatctagtatagagaatggatagaaattttaatagacctgcctaatttacattgttaggaattctgtaaaactgagagttatgccagcaaacctacatgtgctgtctttttaattgcatttctccccaccaccagcccaccctcattccctaatatctgtggttagtacctatggagtcattacttacattatgaagtgacaaacataggaaagcatggctttgttctctgaatgcagataactcatatccatcaaagtttctaatttacagagctttcctttgaaggaggctagaatgctgagtaatgatgaaaaagcaacatttgttaaatctgatttggcgcaggacttctttttctacaaagcagtctttcataataccagcttgaatctaactatttctcttacgtagtatagggggaaagaaatatcttttcttcccatcttagattcatagctaggaccccttaacaacaacaataacaacaacaacaaaaaaaaaacagattacccgactaccaagagaaaagcatacaaagttatttatttatttatttatttatttatttatttatttatttattattttttgagatggagtctcgctctgtcgccgaggctggagtgcagtggtgcgatcttggctcactgcaacctccgcctcccaggttcaagcaattctcctgcctcagcctcctgagtagctgggattacagatgtgcaccaccatgcctggctaatttttgtatttttagtagagatggagtttcaccgtgttgacgaggctggtgttgaactcctgacctcaggtgatccacccaccttggcctcccaaagtgctgggattacaggcgtaagccactgtgcccagcccaaatttatttaatatacgtaaattttatgtgacacaggaaatttaattaggaaataaagacccaaagaaacaggaaaacctgtgtgttcttttttttttttttttaaattggcattcatgttgctttttttttttttttttttttttttttactattaggaacttttattattattatactttaagttttagggtacatgtgcacattgtgcaggttagttacatatgtatacatgtgccatgctggtgtgctgcacccattaactcgtcatttagcattaggtgtatctcctaatgctatccctccccactccccccaccccacaacagtccccagagtgtgatgttccccttcctgtgtccatgtgttctcgttgttcaattcccatctatgagtgagaacatgtggtgtttggttttttgtccttacgatagtttactgagaatgattatttccaatttcatccatgtccctaaaaaggacatgaactcatcattttttatggctgcatagtattccatggtgtatatgtgccacattttcttaatccagtctatcattgttagacatttgggttggttccaagtctttgctattgtgaatagtgccgcaataaacatacgtgtgcatgtgtctttatagcagcatgatttatagtcctttgggtatatacccagtaatgggttggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcattttttcatgtgtcttttggctgcataaatgtcttcttttgagaagtgtctgttcatatcctttgcccactttttgatggtgttgtttgtttttttcttgtaaatttgtttgagttcattgtagattctggatattagccctttgtcagatgagtagattgcgaaaattttctcccattctgtaggttgcctgttcactctgaaggtggtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtttaaggtgtaaggaagggatgcagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagtttgaagtcaggtagcgtgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggaagtatggccattttcacggtattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactgctgaagttgtttatcagcttgaggagattttgtgctgagacaatggggttttctagatatacaatcatgtcatctgcaaacagggacaacttgacttcctcttttcctaattgaataccctttatttccttctcctgcctaattgccctggccagaacttccaagactatgttgaataggagtggtgagagagggcatccctgtcttgtgccagttttcaaagggaatgcttccagtttttgcccatttagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggattttggtctaaaattctcttttttggttgtgtctctgccaggctttggtatcaggacgatgctggcctcataaaatcagttagggaggattccctctttttctattgattggaatagtttcagaaggaatggtaccagttcctccttgtacctctggtagaattcggctgtgaatccatctggtcctggactctttttggttggtaagctattgattattgccacaatttcagagactcttattggtctactcagagattcaacttcttcctggtttagtcttgggagggtgtatatgtcaaggaatttatccatttcttcaagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagtggtctatcaattttgttgatccttttaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtatggtttctgccgagagatccgctgttagtctgatgggcttccctttgagggtaacccgacctttctctctggctgcccttaacattttttccttcatttcaactttggtgaatctgacaattatgtgtcttggagttgctcttctctaggagaatctttgtggcgttctctgtatttcctgaatctgaacgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggtttttctagttatacattcttctaaatttttttcaaagttttcaacttctttgcctttggtttgaatatcctcccgtagctcagagtaatttgatcgtctgaagccttcttctctcagcttgtcaaagtcattctccgtccagctttgttccgttgctggtgaggagctgcgttcctttggaggaggagaggcgctctgatttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgtggtgtcagtgtgcccctgctggagggtgcctcccagttaggctgctcgggggtcagaggtcagggacccacttgaggaggcagcctgcccgttctcagatctccagctgcatgttgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgctgccttgcagtttgatctcagactgctgtgctagcaatcagcgagattccgtgggcgtaggaccctccgagccaggtgcgggatataatctcgtggtgcaccgttttttaagcccgtcggaaaagcgcagtattcgggtgggagtgatccgattttccaggtgccgtccgtcacccctttctttgaccaggaaagggaactccctgaccccttgcgcttcctgagtgaggcaatgcctcgccctgcttcggcttgcgcacggtgcgcgcacccactgtcctgcgcccactgtctggcactccctagtgagatgaacccggtacctcagatggaaatgcagaaatcacctgtcttctgcgtcgctcacgctgggagctgtagaccagagctgttcctattcagccatcttggctcaggaacccaaacctgtgtattcttatgcttaggtttgatgaagaagtggagggtagtggagaaatatgactggacaaaggggatatgatctaataataataaagtgtgggggacttaacaaggcctgtgttttctgattcttttctgtgtccttgtatcttcagagataaggatgttcctttcctctgaatgtggggtttgggggtacctctggaatgaaggttttatggcctgcttcaagagagaagggcaaggggaaggtgagagtgaccttgcttctgctattttatcaaatgccaaggtgacatactgttggtagcgggtcttgaaccccatcagtagcaaaacaagggacttctcactctgaaaagctggtagattagtgaattctacatctgaaggattatactcataataataaacatataaaataagccataaggccgggcaccgtggctcatgcctgtaatcctagcacaccgggaggcggaggcgggcggatcatgaggtcaggagttcgagatcagcctggccagtatggtgaaaccccatctctactaaaaatacaaaaattagctgggtgtggtggcacacgcctactgtagtcccagctactcaagaggctgaggcaggagaatcgctggaacccggaaggtggaggttgcagtgagccgagatcgcgccactgcattccagcctcagcgacagagcgagacaccatctcaaaaaaaataataaataaaaaaaaagccataaggccatgaatgtactccatcaataggtatttactgaagaaatactatgtgcttagtactgtgggaaatataaatgtagaaagcttgctctgtttacttgggtaatcaagacttataaaaaataaaagaattatatgcaaaaacaaatatgtaccaaaatgatgttctataggtttcatatatcctagaattttcaaaataatcaaaattcattatcacatcacatgtttacatttttagtgcaaaaaataggctctgtggcaataggacctcagagaaggacaagatcactatagtttgtgatactccaaaaagtcttcacagaggaggcaacgcagcttgtttatcctacagatattgtgtcatctcttttcagataattgtctgattatacctgtggctatttccccctgaatttcttactagttggtttttggttttgtttctgtttttcaggataaggtcttgctctgttgtccaggctggagggcagtggtgcagtcatggttcactgcaaccttggctcaagtgatcctcctgcctcagcctcctgagtagctgggactacaggcatgcgccactgtatctggcctgtttttttcttttatcttcttttttactcattcataataatgcagaattagaagcaatcccatgtctttgttttatctttatcgaggtataattggcaaattatgtatattcaaggtgtacagcatgatatttttatatgcatatacattgtggaatgatttctacaatcaagctaattaacctgtcacctcacatagtgatggagtccatagtgatggacctcacaggtttttttcgagttaatttttgcattgcttcaacactgcttctaccagagtccccattcaaacacatatcactatggtagttcacagtaacatggaagaaatcattacagagcatttgaactggataattttatttattcattgtggtcagacagcaagtctaattctgttgtcatttttatacaggtgatggtttaagaaaaaaaattatttacagacctcaacagcctatctcgatttctgtatttttcttatcaatgaaataataaagatgagcgcttcaaactatgcctctcacaactttcacaaagcatggcaataatctataatttatgtcactctcacctgtaaggctgagaatcattgacagaacctaaagggagggaaaaaagtcatctttctagataaagtgatgatagtttttcccagcttttaaaaaaatatatgcaaggaatttgtggtgaaatacaatagcattttaataaattgttattaacttgtattactaataaaaatttaagcctattgatctcacctgagaagcttaaaacattgaccagctaaggctttagtcacacatattcttagagtttctgagaaaccaatagcttttatgattttaaaaaatctatttacaaacatcatcttcacattcctctagccctgctttttttaaaggaaaccctacaggcaaaaatgcaatttttccaaagttggacatatggctgatgtcagaaccagcaaaatcatgttatacaaagccaaacgctgagttaaacctcccaatgctgatgttcatcagaccccagaataggtgtctgttacaggatgagcaagatgttagtcatagaagtagaactctgtggagatataactactcacctgcaaaatcaggtggctctgaaaatgaatagcactgtagcgttgggccaattcctgctgcccttggcactgggaatgcaatcttgtatggcaaatcaaatgagcagaaggcttggggccagaatactatcaagctcttctcaaactttaaatggatgagaagtcctgctcactgccatggaacatggcatggattttaagtgcctagtaggccattttattttgttctgttctttcttatttttggtaagcagagctggcagtatgagataaacttacataaacagtgagttcttgatttttatatttctcatatagatccaaaatcagcagcttcatttacacgtagctgtaaaactagaggagataaagtaatagcgtaggattatgttgaaaaatcaggatggggaagaatccccagaagagcttgacattttattaatccctactgaaaaacatgttccaaaatttttaaaaatgtccttctaatagcatatatatatgtatgtatgtgtgtgtatgtgtgtatatatatatatgtgtgtgtatatatatgtttgtgtgtgtatatatatatgtgtgtatatatatatatagttttttccatctagttttctctcagtagtgtctatttaatctagaaagcttctcaagccatgaacttctctatggattagattctgtgtattagagcgcaagtgagtatagctttagtccttgaatgagcagggaaactcctcaatgagaaaatatgggattttccaagaaattcctccagggcccttcctattcttaatcttttctctgtagctgaggataatagctgcataccttctagctcccccaattctagaaacaagaataataaagccttgacaatccatgagaagactttaatctgccctcaggattcccgattccagctcagtttctaatgttcctggatggtgactcatatctcaaaggcaattttggatttaaaatggttttccaaatctacataaagaatttctggattgtttgctgttttaaattagccaaaccaccctttctctctaacagcctgtataattgagagttggctatacattgtttgatacctgtaaaaagtaattgaacattctgaatagtgtattttgatgactgcaatttcaggtgcccaagcttgaccaggttgcttcgtttttgctcacagtggtattcagatatgcccctatttaaacaacccaataaatgaaaataatattttacaagattgataaatgaaggtgatttttttcccctcagagatctcttacttttaaaagagattcattgtattgttagtcatgtcctccgttgcattgaaaacatctgtttcaaaaaaaattcacatttatgggttattttcctcaaattattattttcctcatattgtaagtcacctggatctacaaaaataggctaaaagacagttattaccacgtgtcatattcaccagttctctcttttctttaaaaatgcttagatgtctttaaaatggtttttaagtgtttaaaggaatagtagtccatgcatagccctcagtatacctaagaagatgaagtatacttgtgactctgattgataagaatgcctgtaattttcaacagaggttactgtttcagtggtggcccagatatccatctgtcagtctttgtcaaatagcttatttgttatttttctgtagtctcttaaactgttattttttatttatttttattttttatttttattttttttgagatggagtctcactctgtcacccaggctggagtgcagtggcgcgatctcggctcacctcctccccccagggtcaagcgattctcctgcctcagcctcccgagtagctggcattacaggcgcgctgtaatttttgtacttttagtagagacgggttttcaccatcttggccaggctggtcttgaactcctgacctcatgatccacccgcctcggcctcccaaagtgctgggattacaggcgtgagccacagcgtctggccccttaaactgtttttgttctttccatacattcattccctacccccctgctttttcccaatgttccattctaaaagtgaataaaaaaattcacctaccaaatctggataacaagaatgttatttcattttactttaatctttgctattcttagaccttcttttcttcttcatcttttccaattgaaataaaaaagatttttgatgtatgtacaggctatgtttttttaaaagaactgttaaaattgtgcaacttcaaagcgtttccaaatgttgcattttcaaaaatgttttatcatatttttctttaaatttcctgttgctgtgtagtctcaatgatggctgaaggcactgaattttacattctatattgctttttgtgttccacatctagttagtagttataacttctcccacacaataacagtgcttttgtggaaataattactcaaagatgatttatttctaatgattttttcatatcatgattttaaaatatcttctaatttccacttacataaatgttttccttctctatttagatagaacacagatacatgttgattacatcctaatctatccttcatctacttcccagaaagatttcaggtggtttttgcaacaaaggcccattaaagttaaattaaaagttagagggaaacttttacacaattattccaaatatgtaaattaaggctagttactattattgagcattaaatttagctctgagcttactggaagccaatacagaaaagaaaacatgttatgttttataattcttattatctgacgaaacacagacagtttaaaatggaagacgaagtacaacattgtctttggtaatagttttagagatgatccaagaacgttcttcatgatcacttgtttcatcaacgaaccactttcatactgcctttgtgttcatttatgaaacacaattaaatattgctgttttggtctaaatgtgtctccccagaatttgtatgttgaagtctaccctccattgtgattgtattagaaggtggggcctttgggagttgattaggtcatgaaggctctgccctcatgaatggaattagtgcccttacagaagaggcctgagggagcttgtttgccccttccaccatgtgagggcacagtgagaaggtgcagtctatgaggaagcagtccctcaccagacactgctggcaccatgatattattagacgtcccagctgccagaactgtgagaaataaatttccgttgtttacaagttacccagtctatggtattttgttatagcattccaaatgaactagacaattgcatttatggaatacaatttgcaacacattgtacaaaatgatgtatattctggaatgagtcctcttcccactccttactcccctttccttacatacacattccttgcctttcctcacccccaacaatagttctgggacaggaagattttcatttacttctaaggaggtataaaatcttgatatggtttggctgcccacatctcatcttgatttgtagttcccataatctccatgtgtggtgggagggacccagtgggaggtaattgaatcatggcggtggtttcctccatgctattctcaggatagtatgttctcaggagatctgatggttttataagaggcttcccccttggctctgttctcattctctctcctgctgccctttgaagaggtgccttagccacaattgtaagtctcctgaggcctccccagccttggggaactgtgaatcaattaaacctcttttctttataaattacccagtcttgggtatttcttcaaagcagcataggaatggactaatacaaatcttaattcttcttgtaaacatttattgaacaccaactttgtgcatctttctcttttcaaattataaattatttcaaatgtacagaaaatgttatccctagaactcttaccaaacagactttatagaagtttgtgattagtaactatctgccaatagaagtcatttgcacataggtcctagaatcatagaattttaaaggtgaaaatgaggttaaagaacattcgctaactccttccttttacataaacattaaggacttatataggttcttatacctagttagtagaaaagttgatgacagaacttacgtcctctagtactttttctactataccataatatagatttgctggattatatatacattcaaactgtgcttctattcctgtatgtgataaacccaagcctcgtgtgatcttgttactctctatacagaacttacatccttgattagtatgtagactatcagtttgtttatttttttaagagatggggtctcgctatgttgcccagcctggtctcaaacttctggactcaagcagtctgcctgcctggtcctcccacagtgctgggattataagcgtgagccaccacacatctggcccagactttcaagtttcatagtgaaagtgtctggcagattaatgagttgttgatgcattcagtcaagaaatacttctgaactatgaggttcataatttgaggtttatctggttaaaatcatgactgctttcattagtgctttaattagttgaattctgtatttcagagaggcaaaactaggaactgcattttactgataaaattgagttatactatgccttttaggcaaatggaaccctcatttttttttgtccttatggtcattattaatattttgtttgttcttatttttgcttggagaaggagaactatcattgcattactgcaaacagtatatttatttacctcctgcccatgaacacttctttccctatttggagaaataagatactgtttgttcacagacctccctagtggtctgtctgttaagcagcggcagtcctgaactaagggcacaagaaaatggagctggtaatcacaagcaaataatgcaagacttttaacactttacatgacagattcaggtggggcttgcctactttattatccaaggtgttgctatttcctttcatgcctttggagatcccagaagaaggggagctagctgagtcaaacctctgtctcacagggctttcatgaacaatgacaattcatttcagcctagaggcaaagagggtgccttttcttacgagacttttgttcttattgcctggtgaatttttaaatcaaattggtggaaaattggaatgttttcctctcttttgtccttttgcatctccatacctccctccctcccagtatttttgagaccagatagaagcagatagactcatgggggattcctttgtccctaactcctatctagagtacttccttttcctaatatatatagaaatgatttgaaagaattctaactaacctcagatatggagataatgaccacgattaaatggactgaacatctcattcttatcaattccaattcataatcctattttatttaagtggttatctttgtcctttggaattccaatcagccaaaggatgccagtactgttaataataccgtatgccaagggaaattatttcctctgcttccacgactaccagggttcactttgtggaagctgtgtgataacataatccctcttacccaccacctcttttgggcaatatttgaaaaatgaaaaagggaaaagagctgggggagaaatcattcaagtaaatttacgatagtttcaaaaccagatttgctcattaaaaatagtacttgaaatagatagcagctgtggtttccattttgtaatttttttatgatctatttcatttctgttttctaagctacttaaaactgttgtaagctattgataatataattttccccaaattatttggctcctcatttcattttccctgctgtgttttataaaatttcatatcagaaataagaattaactagatatttttgaaatcatgagtaatttttattcactgtagaattagatttcttttaagaaaaagaaagctagtacagtaaaaatcagcatttcagatgtgggtggcaagaattaactagattttagagtaaaccgtagaatagtaccctcctctttgctccttaccatactttgttttctgagcatttatcaccacccgtcatgtatttatttgttcatcatttgtcttctgctccccactgaaatgtaacctccatgagagaagatgctttaactcctctagttacccaaagactctccagtgcctagaacagtgtttggcaaatatttatagtagttgctcaatatttgttgtattagtgattagcctgcatgagctatctggcttgcccatttcaagtgctgtgatgaatattctatgccggagaaatcatcctccagactggatcgttaccattatcttcatttggcattttattaccaacaagatagtaccccaggtaccatagtaaaaatgacttaagtgctttccatgtccatgtgcctttatattttacttaacaacatatattcttcacattgacatacattcattcagtaaatatttgttgaaaacttacaatgagtcagacacttacttgcccagaaatagaggcatagataagatattgcacctttactgtaactctactagaacacaaccctagaaaaaattcagaatctgtcatctccatagttgtggatttctctacaaagttgaaatttattgttgtttttgtgacaacaacatacgtttcctgatttttctgataccttttgattcatcctcatcattgatgtttctttttctccttgtacattaaatgcttttgttcaccaaggttcaaccctcacactctacacaagaatctttctgtgtgatttcacccactctcatatttttaactgtctatatgcaaatcatttctaactccgtagctatagcctacagttcttcctggaacttaaggcttgcataatgaaatgcctgctggacaattctacctagatgttcaataggcaccttcagttcatgtcaaaatcttaactctgctttttcttctaaaatctattccgtttttgattctttgtaggcggcaccaccatccagctactcactctagcagggaactgggtgtgaaccttgattcttccttctctataaatctccacatctcacaatctctgtatcctgcccgttttccttcctaaatatttcttgaatgtgtcacctctgtggcttcctaactaccattgtcctattcccatgttttaccaactgttgctgagacaactgcagcaatcttctaaatggcattccagcttccagtcttgtcccccttcaaatccctgcattcttttataattttgcccactgtgtccccctgcctggactgccctcccttgttcttttcattggatgaactcctgctcatccttttaaaactcaattcggccccatcaccggggggctatgaatatactttctcagttcttgcatggtgctttcagcatgttgttcccactgaattcccacactgctttgtctttgtttctttacctgcctgtctttcctattagatagtgagctcattgggagcatgtcttatttatctttgtagatccggcattaagcatgtcattgggaacttaataggcccttcagacatttttgaataaatgagtagatgaatgaacaaaagaacaaacagcaaacaaagggtagccttgaggtacagtataagtatatcaaagaatacaatattcttttactttagatatcaaccttataatttattaggagaaataaaaacacaaaagggcagtaatataccagcccacatgtagtctcatattccagtacagttttatctgactttgcctttttgatactgatgacacagggagcatctggggctagataaactgctcatgctctgaactatatgttgaatattttgatagaaactctttttgcctgtggcttatttgtcatatgccgcttgagtgtgaacttaatttgcatgactgcaataaatgaaaagtgtttcttatttcctactttgagtacataaatttgaccttgatcaatgtcagcaaaccaggcctctggcaaccacttcacaattttgactatccagagaagttcatcatcatctttagacaactttaccctggaatggcaggtttagttagtatcagtggagtcttgtcagacgtgtttcctaacaaaaatgacctcaagcaggagtgtgtggttttctctgagaaagcttttcttcccctgagcagatcatagcctccacaaatgtctttgaaacaggcatgcaaagattgctctatacagaagattgtgacaccgaacatgaggttgcttcgaatggttatcctaaagtgacctgccaaactgaagggcaaaaatgccactgctcttgaagtcttaaaatagtatctcttcttgttgaatccatgggaatagaaaaaagaaattgtggtcaggccatatgagaaggaatgccaaaaaaaaaaaaaaaagtcaccaaatccatttagcacttggtaacaaaaggtaagaatagacattgaatactgtactatttttagtatccattccagcatagtgctaagtatgtcttgcctccaaagtgtgttactccttctaccttctccatctctaacagtaataagcccagtcacctaagttcaaactctgagtcaactttgactcaagcttctcattgattccctagaaccattggttaccaatttagatttcattatctcttgaaactgttgtacctccaagtactctaaaattctcttatttgaacatgtccacttccttccacctttcctagtccacacccactctgcttctgcttttccgtttggtattctacaagcctttttcccattcaacttttccatctatctcatttctgtccctacccaactatgactctgctgtccaacatgtcagtacgtactcaaaagcactcctcattcattctctacccaattctcagctgctcctagccccaaccctgcaaataaccattgtccattttctcctctactgttcccggactaattaatgctggtaggcaacgacatataatagtagcatgttgatcaggcccactgcaagcgaaagaaaaattctaaattcattagttagaattttgaaaacaaaacatctgtcctaatacatctacttggttctgaaaaactgtgattactgtagttattgagaggtttctgtaacccaaatacttaactgggtcgtacatgaaaattatttttaagattaaaagtagagcatatattgtactgacagaattttctttaggatttacatgagtctaatctgatagaatggaggaatgtaattgaaaactaggaagagaaatctaggcatggaacttcatcatccaaacatttttttccctgattaaaagcaacatatcagcgtgtgtttttcaaatacaggcagtccctatcttacaaatggctgtagacagatgtagggcatattattgtttgaatcctgattacccaagtgggaaaactttgctttagatgtcagttgtttggaatccagaaagcattttcctaccaaggcagtgttataaatggtggttgggctcccctaggatagccaataatgttactgaaatactatacatttgcagtgaaacagtagtgaacacatttatcatatactactaattaaacaaaagcaataacgttgaataagatcattttatattttgggcttcaatggtggtgcttgaggaaaaacaggtttaattataagaggatgaaaaagtagatggagactgtgtgaaatctcaaaatagggctcatgagcatttttgaagacttcaaatgacacgtgttctttatcaagtctaactgattttaaaacttgtgaacttttacttccctttttgtggttctaagtgttttgtagtacaactgttgtgctatgattctggtcagtttttgactagtgatgaaaataaaacaagggaagaggataaaggaagaggatatggtgccagaggaaaattttgagaagagggggcttatatgcaaatatgaggattaaaaaaacaactttatactttagcaccacaagcattccacaagcaccagcaaccaaaggaaaaggagttctttcttgcttagttcttaggccatcctatataaatgtcctaaatagagataaaagttgcaataagttaaagaggctaagttgagccacactataaggagatgatatgtaaaccgcaaagcttgcatgagctgaggtaggaagagagttatttatttgcttttgttgttgttatttgtttttttgtcttcagttgtgtcttaatctgtttagtgttgctataaaggaatacctgaggctgggtaatttataacgaaaggagatttatttggtttacggttctgcagactgcacaggaagcacagtgccagcgtctgcttctggtgagggctttaggttaattccatttatggcagaaggagaaggggagctggcatgtgcagagaccaaatgacaagaaagagagagggaagggagcttacaggtttttgtttttgtttttaaacaaccagctttctcaggaactaatggagcaagaactcactcattaccacaaggaggacatcaagtcattcatgagggatccacctccatgacccaaattcctcccatcgggccccacttccaacattggggatcaaatttcaacatgaggtttgggggataaacattcgaactatggaaagttgtatggactatatcttggaagacggaaggatatgttggaagtgtgctaccttctaagtgtcaaaggttgagtcagagaaacatagagaaaaaaaggccaaggtgggcagatcacaaggtcaggagaccagcttggccaacatggtgaaaccccatctctacaaaaatatatatatatatgctggacatggtggcacgtgtctgtaatctcagctactcaggagactgaggcaggataatcgcttgaatccgggaggcggaggttgcagtgagctgagatggcgccactgcactccagcctgggtgaaagagcaagacactgtatcaaaaaaaaaaaaagattttagttctgttgcacattataaatggaatcctcctttgatatccttggaaaggatttggtaactacttatattgtttttcagtcatgttttgtattcacattcatttttacttggatatgactctgtactggtagggaactatgaggcaacttggctttattcaagttatataggtgtgatagatttcccaagatcacattaattgagctgtcagtgggggacaaaagagtatgattactctaaagaggaagaatagaggaggtagaagaagacagatatagagccacatagttaattctctttgctgtttaccagctgatgaaccaacaattattcaacaattttttactgtgctgtgttctaggcaatgtgctaagtgcttagagatgcagtggcaaagtacttggaatacagtagtacacatgatattacatctgccctcatatgttttacagataaggggacggtacagataagtagataaggaattataatgaattatgttaagtgctaatgtggaggtactgttgggtattaagggcatatatagaaaaatcacctaaatctgactttcagaattagcacacatcctagagcattctaaactgatatagaaagatgtgtcagagtgaaacaggaaaacagaagttaggcaagaggcaaatattcctgaaagaagaaataatgtttaagattcaatcatacaacaagaagcctagagagagtactgggaaaaaaaaatagccaaagagagatttctacttctgaaaattgtatagtaacttgtggcagaacaatgctctgccaagaatatctacataagccagataacagacaaaaagtctgtttgaaggcattggaaagtagccaagacagccagggcttgagaagttaaaatctcaagcaaggaaaactacagagaaatgaggcatatttccttttggggcatttgccaattcttacagcatgatacagagaagtcaccagaagttccagctatcttataggcttagagagagaggaaaacattgagggctgtcaaggcagtcagtactgaagggggccaaaatcctgaagagagtggatgagtagagaaatgaacttgcactcagtagttttaacctccaggcatttgccaaatccttaagctgttcatgggatgaaaaagcctaacccgtcaagcagtaagtgactgaaaagcagagtggagctttcccactcatagtataaaagaaatagaaaataatgttcagggccctccacagaggagcagccccaagaaacaccccagcatttcatttgggactcttaaagaacctaccctttaggaattggtatgaactaaatatagactgaacttttgaaagactgcaacttcacctatttgttcgttgattccttgattagattaaggtgatctacctctactccagctgcctataaatgatagagagaaccctctctggaggaaaatatcatctagtggctccaagatttctgcaaacaaaatgtctatatttaatcatgcattaattggcttatgaagaaactgaaccaagggaaaaatcagacaatagaaatagacctaccaatgagtcagctgttgacattctcatagacttttaaattagcatgattttttaaattactatgattaataagtttgagaaaatagatgacagtattgagaatctctccaaggaactggaatccattaaaaaataataaagaggtaggaggacagtgacaattagtgaaaactgtttcaataaggaaagagtagctgatactgacttatactacagtgaggtcctttggatatagtaacaaggagcacaggtactaagaagtcctttgggtttcataggtagatcgttggtgagtgcaggttcagtggagtggtgggtaaagaggccatgatggtgataaggtcagatttgaggtgagtagggaaggtgactatggaaacatgaaaggtatgatgggcttaaaattttggtccattaatttgtagtgtcataaatctattatatacgactctttaattttctctagaaacactcatcgacttgattagaaataatagagataggttgtattgttctccttccgtcttccccctttcccattccttcctctcccttccccttccttcttccagtcgttttccatttttacttccttttccactactattttacattatttttctttattcttctttccttttcttcctttctttgttttctaatagaagaaatagaaataacatttgtagattgaggagagagagcttgtatattgagagacctcgttagactcaaagcatgccatcataaatctgagatatttagaatatgtattccagtaaaatcggctaactaacttaatttttacagacatagcatacatcacagttaaaatgccttttagaggcccattctgttttacaagaccaaaattaaatgtatatatgcttatatacatactaatgtttatctgttatgtgcacatatctgtgtgcatccatgtatgtaacaactcagtgttttactgaagtaaatttttaggattgaaagaaataggtttctctagttgtatagactgcttatgagaacattacaattcgatatgtagagagatgatgattacaatttattagtccatcaccatttggaacaatagatggccaaatgtaattaaccattgaaagaaatacattttacgtgtcctaaatttcatttctaattacttgtaactgaaactctctagaatcttaaaatccattttgtcttatgaaaggcttcattgcttatccctgttgttgcactattactttagattagagtaacttcattttaaaattacatgtcaaatataatttgctattagtaacgtggaatgtgtggcttcactctgagaaaaaagcctgttcagcattttttaatatcatatacctaaacagagcttccacgatgattagatcacatctggcacaatgtagatctatttgtacttgcataatgcatgtgcatgtacacactgtgatattttacgactatttgggtacattgatttttctataaagagaactattatccacatctttttgcacagaagtacacttaaatattggcataggtaaacaacttactaaaataaaactcgtgcttggcacaactattactggtgtcacagattttacaactataatatttctgaaaagctagcttgaacgctttggaacatttttttctgagtgaatgcagaggcagtttggtgagctgtaaaacttctacttttcattttgtattctagtctaggccaaatcttaagtgtcactaaatctgattctatcttgaattgtggcccagtgtcatccccagaaggaggcttctccccagcactggctaggtaagcagcctatgtgaaacaaaggaagcggctttgccagcaagcaactattaagaatgggaaagagtttgaaataggctaacgaaatgcaaaaaagtaaatccaaagtccaaaagtagaggcagctttaactctgcactatttttatcttgtgatcctgtttgaagaaatgtctcaattcattataactgaagtaaaagtcactagcataatatggaaacaatcttaaactggtaaatattccttctccttacttaacataaaataaaacccatattaagatattagttcctcctcgtcagcaggggaagtctctgtatagactgtctgaggacatggcagttgactgacactagagtgggcaatcccagagactggaaattgatgtcaaaaaatttggttttgcccgctctgtttaatctgtaattagtcaaatttaatcttagtggataaggtatctgaattgggttcccaaaactcatctttatttctatttttttttttacattttgcaataattatgaatattttgaatatttttgaattttgaacataaaagttgcaagaatagtacttggaaatccctgtataccctttgtgcagattcaccattttaaacatttagccacattcattttgttatgcctcttaaatttttaatacttcaattactgtttcctaagagcaagattattcttgtaggtaacaatagcaaagttaccaaattcaggaaatgtatcattaatgtaatacttccatctaatcaaccatccatgttccaatgatgttaactgtctcagtgataccttttatagcattttctcctccaatgcaagatccagtccagaatcacacattgcatcgagttgttatgtcttcttagtctcctttaatgtggaacagttcctcataccattgcatacactgttaaatatgaagaaaactggtcagttattttatagaagattcctcaatttgtatttacctcatgattagattcaggttatgtacttctgtcctaactactagataagcaaagtatgtccttatggttcacatctggaggcacaaaatgtctctctgtccctcactggtaatgttaacttcgatcatctggtcaatgtgttgcctgataccttcattttataggtattattttctctgtttcaactaataagcaatctgtggaaagacactttacgaccatgtaaatatattgctctacatcaaactccccctctagccttaactactattgatgattcattcctgaaccaatctttaccacaacagttgcatgtcatcttgtattaatttcttttggaatgagaagaaaaacaataatttactctggtaattttctgaagaataccgttgatttcctttgacaatgttctaataaaggaaattgctctctatggaatcgtagtgatctgtatcctctgagtagtttactcattctaactcaaccaaaatgagcagaaattaaaagcaaatgatttttgctctagaatcaatacttatgttcacagtcagtatatatgctctgcaacaagttgtactctgggtatacatatacaaaatttcagtgttgcttaaaaaaaaagcatttttattgacttaaatggaagaattctatagttttttaactactttagttttctggaatttgtttactttaaaacttttcagcctttgcttttccatctctttaacaaattatcacctcattcatttagtcatgttctatttaatttatatatttttattcttttgcctttccacattgcctaaatccttgtggctaggattacttaaatttttctacatggttttcattcacccccattcttataaattatgtgtatcatttatttactaaatatcttggtcatgttcaagaattgaagatgagagttttcagttatcacattgaaaaagattaaaatttattatatacatataaatattatactataaaaatccttatgtaagttctgcaaatcagtattttatatatttagtgaactgcacaaaaggcaacttctattcagtgtaataaccctaattttatttcttaattttaaaattttaatcttttctacttaacattctccataaatagcttattgtagtgttacaatgaaagaaaaattttaacatcctcatgaatcctgactacttagtatatacatatgtaaggtgaaataggttaaatagcttatgtgactattttctagttacttcattaagtctctaatgccttttggataaacaaaaatgatgaaaagtaggtcaattggctacctcagccaggtgatcaagatcaacatcattagagatagtgataagacaggtagataatatgttctcttcatgcaatgagaatggcattttgcctctgtcttccccgagaacatataaccccagtctaattatgcggaaattgtcagacaaacccaaattgagggacattctacaaaatacttgaccattactgctcaaaagtatcaaggtcatcagaaacaaggaaagtttaagaagctgtcacaatctagaggagcccaaagagatgtgatagctacatgtgatgctgtatactggctgagatcccgaaacagaaaaaggatagtatgtaaaaactaaggaaatttgcataaagtatggacttcagttaatgatgacttatcaatgttggtttatttgtttgacaaatgtagcacactagtataagatatttacaacaggggaaagtgggtacagagtttatgagcactcttatactatctctgcaatgtttctttaaacctaaaattattctaaaataaaattttattttaaaagatatgtgtattgggaaagttaaatgttatatgaacagtgatgttggattcttaaaatcagaaagtccctgaaagtataccataaaatgttttttttctaattgtatttatttatttttttgagacagagtctcactctatcgcccaggttggagtgcagtggcatgatctcggctcactgcaacctcagcctcctgggttcaagcgattctcctgcctcagcctctcaaatagatgggattgcaggcacgcgccaccacacccagctgatttttatatttttagtagagacggggtttcaccatgttggccaggctggtcgaactcctgacctcaagtgatccacctgcctccgcctcccaaagtgctgggattacaggcgtgagccactgcactcggccaaatggggtttttaaatacttggtaaagaatagatcatgcccaaggtcactatcatctagctttatattttttaaataacaaagtatacaaatatatactgattattgtttcaagtactatatgttatagagaataagaataggaagtgattaaaagactatggtcccagtacatggtaacattggtgaacacaatttatacaaacaacagagaatagagtcttcattccaaccttttacacatccttagggaaagtgctatgtaaatgatacaattgctttatacttcatagggataccacacaaagggaacacttttaatatcaaaggattctaagaatttcaagaagtttactaaatgaggaattagaggaagatgcaggtaagtatatcataaggaaatataattttaaaagcttatcagtgctaactcaggctcagctattataatatgtagcatcttatggacaaggacaaaataaatctcactgaaaacttaagaccatttttcaccttgaaaactcaatgtggaattttccatgaagagcccttgtcatcaaagcactcagatatagtattgaccatatgaagccacactagtacttctggctcattggaatgaaaatatcatatgagtcagcttttaaattttttaaaaattctattattctgatcttaacacattattactacatgaaatttatcctcaacattttgactagctctttttaagtagactattgtacaggtatgacaagtatattaaaatacacataacaatttcatatttgtatcagagtatatcaaattaccaatgtcttcaaatattccatgctagaaatacctgtttgtagaatttctgtactggatcacttacctcttctttctatagcattttggcttcacacctttctcccataaatccaacagttcagttacacttttttcaagtatgtttaaatattggattgaaaatcatgtaccctgaaacctcataaaactctgtcaccaaagagcatgtcatcagattgagtgggatacaatacagacctggattatataaaaattatacgaaattgtacacaagcaattaagtctaaaatacatttctttactgctgaattataagcacggtattgtgctaggtactgtaagggttgaaaataagctgaataaaccataatctctgttttcaaggaccatatagttcattggaggaagcaaacatatatattcacatatttttattacactatatattcatatttcacaatagaggtaaaactgaattatatggacatatggaggagagaaggattgaattttactagggacatctcagaagcattaagggcagaaaaagtatttgaattgggccctaaatgaatgcaggaaacgtcagtaggtaaaaatgggctaggaggatagggaggtatttcagatagagggggcataaagatggaaaagcatgcaatgtttacaagtagcccagtgcaactagagtgagaagtcagatcctggaaggccaaatatatgactggggagtttgaacatcattctgtattagaggtttttgagtggtagaatttcaaaatcctatcttatatttgaatgtctattgggcaatcatgatagacgggaagagacagaaaccacttaagtgatgctataataaggcttgagtttatttaagtagatacgttcacttaattttaacaggttagttaggtgtggtaaacagcctctaagatagttccgaatgattcctgcctcctggtattcatgttctttgagtttggggttggcctagtgactggcttctaacaatagaaggagaaattgatgggatgtcccctctgagattaggttataaaaagaatgtggttcccttccatcttctgtgctcactctctgtctcacagatcatgagcttccatgttgtgaggacacttaagcagtttatagagtgggccacatgtccaggaaaacctggttgccagcagccatgtgaatggacttagaagaaggtcttgccctggttgaaccttatttgaaatcgaagccttgatcagtggcttgactataacctcataatagaccttgtgccagatacactacttaagctaagactaaattcttttttttttttttttttgagacagtctcgttctgttgcccaggctggagtgcagtggtgcgatctcggctcactgcaagctccgcctcccgggttcacgccattctcctgcctcagcctccccagtagctgggactacaggcgcccgccaccgcacccagctaattttttgtatttttagtagagacggggtttcaccatgttagccaggatggtctcgatctcctgacctcgtgatctgcccgcctcggcctcccaaagtgctgggattacaggtgtgagccaccgcgcccagccaagactaaattcttgacatatagaaactgtgaggtaatacatatttattgttttaagccattaaattttgccataatttattaggcagcaatatgtcattaacagaagtcaaatccaatatctagcctggtttatctttgtactaaattattgaatattttatttctatcatttctatacataatatggcttaaagattactgaattataaataaaatctagaattttctccatattgcttagtataatcttaactattatattgtgaaagctttgtgatcccttgcatttacagcttttagagaaatgaaagatacaggatttatatgtaagagaggtcttagaaacctattttgaaattaaacatttttaatattttctgttaatcctttttaggaaaaaaaaatttgtttataaagtttttactaaagttaaagaacactaactttatggattcactgcagctttgataatgaaaaaactactggaaaagaattaaagaagttgctaatcagttcattaatcaagtgtatctgctgcacattatactgaaacaaattgaaaaggatgctgtgctagccagaaactccctctcaaataaagtcaaaagtgaagataaactaaattgacttttcgtttgtggttgatttctatctaagtagatccatctctaaaacactgaataaagaaagttgccccatacatagattcaagactccactaggattctgtatcttaatactactgagaataacttgaactatatttaatcagtctgtctttagtttttgtttttcgttttgttttcatttacaacccacagaccactttcatttttaaatgttaaatatacttagaaagaagaagaaaaaaacaacatcaccttgctcactgcattaagacaactggttttgtaacccgatcaaaagaattaaatagctttctatatagcttaccctcccacaaaatctttcaatgcacaaaatatttgtcagtggtcagaatgattccagtccatcccactctctgtggtgccttaactataaaaatggcagtgaggcattgcagcttgaaaaaaatacagtcagattttcaattatgattagagtagatctcccagagaggtctccacagaaggcccaaggttctctaaagggtaaaaggagtgacaaaattctgacataaaacaatgtagtctttcctctcttttcttgataccgaccttcaaatattttggggtttttaaaagccaaattctagaagaaattgaaggttcaaaattggaattcgcttgagtttcattaggtttaagccagataccagcctatgtcattttctaaaagcagaataatttagttttaaagcaatagtacaagacgaacaaacaggtacctggcaatcacattaagactcccttggtgtagacagatatgtataacttcttttgacaggttattttgtttattcattcatttaattttggcacttaattttaaaagagcttagaaatcatagtcttttgatagatataattggtatgaatctgaaatcagtaaactaagatgcataagaaatgtaattttctttattttcttgtaactgaattaattctatcttaagaccctattctactggaaggtaccatggaagataagaaaacaaaccacaaaaaaatacacaaatttatacttacttcacatactgtccccaccatgttataaggatataatactcatccattaagacatgagttgcatgtttaccccattatagattatttaggattatgctgaatttacaagtgaaggaaatgagcaaagaaatgccactggataaacagtgttttgctttccagaagcattaatttaagtgactggcccatgattatccatctgctctatcagtgaaagatccctaaagacaatgcttgtcttctatccttgtcatactcagtacactgttcacattagcaagtatttgcccaaaattgctcaatttgggatacagaatagaaatatatgtacagtagtgagtcactgataggatctgagtgaaaattttttacatttttttaaggcttagatgaatggacacagttttctattgttttgtttacctttgtctggtttcccttcccacccccatgcacgtgctcatgtgtgtttaattaaacaaagaagagttccaggaagttgggaatgtcaaatgggaacagacaccttcgcaggagctgagaaaatatgctatatcatttatccttgtggaaacatgcaaaccagatttgaatagtttttaattgatttgcaaactttgcagtagaattttctggtaattagcaacttgctgagattaagtgaagtcatagttagcttcacagtggtttaaatcatatttcattgttttgcatgttttaaaagtcatgttgtaaattaaaaacgcaaagaaaaaatcaccaacttattaatagagaattgatcattatgcaaccaattagaagatataaataaatatacaaatcaatcacgtataaaatggtaggtgctgcagaatgttaacactgtacaggcaagtgcttgacaaataataatgagctataaagatagactagaagcaaaacagtaatgtggcagctttgttggaaatattttctagaaatgaagatgcatgaccttccgtacctttgttaatcatcagttatagatagttaaaatgttatatttacaataattctgtgacttttaaagtaattgtttatacaactacattgagcttactagtggcagtatgttcatatgtacatgtgtctctcttgagctctcaggagagagaaaaaatctgaggaagtgctagcaagcataagcagggagataagaaaaataaactatcttataagtacaataaaaatcacccatgcctcatggataacctaacttcccaattaaacatgacgtttcctccaaaatattaagcgacaaactagaattctgtttcggaagccaaggaaattaaagaaaaatagagtcaagggttaagtagaagagaagagacttaattacatttagcaagggtcccaatccacttagatacttactagggtactcagcacttgttcactgcagcatttgcatttagcacttttaaaattgggatgaaatgagttttatagatactagaggaatcattatgagatcacaaagaagtactgtgataccataactgaagctaggagaagggaaagcaaattcatatcacagaggaaagcaaacttccatcctctcaagttatctttccagtcaacattgccgcatatcacatatggtgtgcaaaaggggacagattaatgaagtactcaacaggaaggtataacaatccaaaatatgtcctttgtgactctctatccatttctgccatattccaaggaaatgcagatgtatcttcatttctatgccatgatatacttgggctgggaatgggggacaaacccagagtgattgttctcttttcctgtgttcatagtgtatatgtgcacacacatgtgagggtgagcctacacctgttcataccccatggcagtctgacttcactgattactttctagaatcttttttcctttatgtgccctggacaagagagtggacaggaaacatggtaacaaaaacaaagataaacatccttctataattctaaagaagcatttttctgtttcctcctaggagaaataaaaatgtataatttaaattaccaattaggatcatgttgggctttaaaatttttggggggtaaattgtatgagggttgcaaaaaagtcatgcagagaaagatactgaaatctcctaatacaacatgttgagaagaaagttaatgatcagtttttctggtagtttttgcatataagcctacttggaagcactgtgtaggcctaactgacgttagtgaatcagcagagagctgatttgaaatgcattatccgataggcatgagattaagcagtttgataggcatcttagagctgtttccatggccttattaatttgtaacagttgtgtggtaagttatgtcaacctcccagtcagaaagtcttcagtaagtttttcaggctccaagttgagggatgggtaagaccctgggacaacaccctagtggaggcttataggagagtttaagcatttctgaatgcttaaattctggatgctacattctggatgctacaggcccagaattccacactaaagtatttgtttggagaactcaagtatattatgggtatcttatttgtattatgtgtaagtaaatatcaacataggtttgatcatttaatcccatatcctgattttgctctaagcgaaggcagttatttgagtgccagctcagaaaaggtaattcactattacctgttaagtgtgatgaaacaggacttctcagcatatctttcttgatggtattttaggttcaaagctgatggattagctttttgccctttcacacattctacctatcagtgacaccatggccaagggagacaatccaattcacttccctgacagaattgtgggtgatggttatatcattacgtatcctggaatgcaagactctgcttgtattgatcttaaacatataagctaaactcagtagcaaaaacataaccgatatatggtggggaaaacgacaagggagtgttttctaaacccaagaaatactcaataaataggctaagaccaagatgaaaagtgcaaagaaccaacaagacaagagtagaaagaatgcggggctcaataaatggtattattctcagaaagtatattccattatctgttgttgtagaacaaactacccaaaacttaatggcttaaaatcattgttcacgattctgcaatctgggctggcttcagcctggcagttcctgccactagtctcatctgaagtcactcacaaaactgcagcccattggtccagggtagtcccattcatatgtttggtggttagttggcaatgtcagcccagcatttcaaatttcatggcttctccagaagggagctcaggcttcttacatggcgcatgtaatgttccaagaagtcaagaatggagactacacagtctcttgagtcctaggtcagaagtcacacatcattacttgtactgcattctgttggtcaaaggagttcacaaggccagcccaggttaaaggggtaatgaaatggattccacctctacatggaagaaggtgcacatagtatgtgtccatatttaaaatgtcacagaatttacaggaatatgaaaataatcatggcaaatgtggtgcattcttaggaagaatttttttttcttttttctttttttgagacagagtctcactctgtcgaccctgggctggagtgcagtgatgcgatcttgactcactgcaacctccacctcccaggttcaagtgattcttctgcctcagcctctcgaatagctgggattacaggtgtgcaccaccacacccggctaattttttatatttttggtagagatggggtttcactatgttggccacgctggtctcaaactcctgacctcaagtgatccgcccacctcaacctcccaaagtgctggaattacaggcgtgagccaccatgcctgcccaggaggaactatttttaatgtccaccattgtatagtgctcccggtacagcctctatttaacaatttttaaaatgtctctacatattttgactctcttaaaagttaataataatgagaaatatttacattgtattcattcaataaacaagtactatgatttctctatcgcgctcagatctatcagaaaccttaaatgtaaatagatcgtttgatgctttattataataattgttaaacattcttcctaagtgcattattgaccattgatagaaaagaaattgcttcatgttatacttattcatcaaaagcacaagaagtgcccttccctgtcaaactccttcaattgtcaccccagcacttcactagagatacaaataatagcacatgaaattgtagctggaagggaaggggaagactggtaaggcttatttaaattgcattccaagcatagaaaacatatcttctttccaaaaaatgaaagctagtacaatattaaatcagtaatatacatacttaaaggcatattattttatgtgatatgttaaccatgacatagagtatctcaaaccaaagtgattcaattgtcattaccatcaacaaaatgaaacttataagtggattgttagcagcctctttttagtttgttgtagagtgttcctctaaagagaggagaggccagaaatcatctcagtacacagacacagtgttgctgcatctccatttttccacaccgattttagtcttgatattacttccctgtggaggctgtctgaaagctaaaagcctatacagaagtaacttaggccaggtcatttttacttactaaaagtcagttttcctataacatgtaccacaagatgttactttaacagttttggttcaagggtcaccagactgtacagactaccagagcttcagcagtggcattctttcaggtggcactctataagttgtctgaatcattgggttaacattctcttcatgttttcatcttagaaaggcaagttaacgtatttttaaagaggtttaagaaggcttaagaaaaagtaaactttttttaatgcattgaaaaaataattttacaatttattcaattcccagagtttttattacagacctactatgtacacaagcatggtgtacccggcagctgtgagaatagcaaagacacagcctcagcctcccaaagtgctgggattacaggtgtgagccaccgcactgggccccagtagatcttttctgtgtatattttcccctactcctctcatctaccctttactccatcctaagtgaatgatgcccttttctctgactatatcttacctttcctacctctatgtctttgttgatcactttcaccctagccactcttcaaggctcgtttcaaacacagatttcttcatgaagacttttctcctgaatacacacactgctacctcaaatccaaagctatttctccttgtttatctcccattgcaccttaattcctctttgggctagagttgtctctgtatcttgtctccaccatccaccaaattttaagacctgaaagtagagacatcattttgttctatctcctaacatactttgcagttaataagaggcaaaataactgtttagttgaattaaaaatgaatgtgaggaaatattgtggccatctgctaaaatgcataggtaacaatgttggaaaagaagtggctcttttttaagtttgatgaaaaaaaaaaaatatatatatatatatatatatatatattcttaaaaaattaatcacttgtccaagatttaacagctaaactaacatttactgtatgttcattattctgcataatatgtttctcatatatgtaaaagcacattatttagtcaaaactatcatattaaatttctcccgtaattcctaagggctgtcagctgctcattaaatcttgattttctgtcaggaggaattaataatcttgcctttgagtgaatttagaagcaatgagggattgagcaggaatatttgaataccctctcggtggtaaattggatatccaattttcaacttagtcttaatgggaaaaaaagaataaattgaattcagaagctgttctttactttttaatatttcctccccacttttaactgagttaaaatggaagggtatagttctttctcagtggtggggaaaatcaactttcattcacttagaaaagtttgtcaaattcgaatgagacttaatatatggacaatctatatgactaagtctataaggtgatcctttggaaatcataggaaaattcagtacaataacacaaaaattgatttgcatgaggtttaaatcgtgtttttctaaaagcaaggaatcctgctcctccctctccccaaatgaattttgttgtcaaatactggtactaacaattattgatatcacaactcagtctctaaaagcaaactgtcctattattaccagagaggtgctaactcacattaacctaataatatatagctcttaattttcagttttcatctttcatcattttttagctactcatgtcttagatttaaagtcccttaaaattataaaaggttgagagactgataaacaggcataaaaccttgtagatttttttcccctccactctttttttctaactaagctacacagtaccatcacgtaccatccatcagtacatttagctgtcatgacgctgccaatagaagttgtccatccactaggcagtataaaattacaatcacgatcttcgctgggagtggcagctcacgcctgtaatcctggcactttgggaggctaaggcaggtggatctcctgaggtcaggggttcaagaccagcctggccaacatggcaagacctcgtctctactaaaaatacaaaaattagctgggcgtggtggtgcatgcctgtaatcccagctactcgggaggctgaggtaggaaaatcactcgaacccaggaggcggaggttgcagtgagccaagatcgcgccattgccctccagcctcggcgacagagtgaggctctgtctcaaaaaaaaaaaagttacaatcatgttctcagtgaggcagtaaggtggaagagtgtatttctttctgtgtagtatgactatatgacctcatgtgtgtcactcacttgcacttattttcaaataccaggcagcagtttgcttgaagttaactatctgttttatcatgcaacttaagaagaagttgtaacacatgcaactccaaattattcttattcataactctgttctatagtaagcatttgaatatggatgcagctcatgtgatgagcatcattctacttgacatgaaggaatgagatccaactgcgaggaccccagtcagaaagagctgaaggcccattgatgcctcaccttttctccctgcttcccccactcttgctagggatcattggcaccaccactcagactgatggtaaaacaagaaattgtcttctgtctagctcagacacatcacttgtccaactcaacccctgctttgggtacaggaagttttaatctggttaagttgaatagagtttgtcttctagcttttgctgtgctaaagcaagagaagtacaaatgtcaacaagcagaataagaagagtataacaagaaatggtaagaagtcaaggccaaaatctagatactgacctgtggataattgagaggtgtcagcaactctcttctaacatcaaacagacataataaaaacctaacaaaagatgttgaagtctgaccagcatacctcttactttgcataggtgctgtttggatttctatgcaagcctgtgcttaaaatcagccttcagattgaatgttgataacctttccttttttacatgcctcatttcagtttatggcattccaaccttttctccctcgtgacgaacacttttttgtatcaatgtgaggcaagctctgtcaattcatctaatcctcaaagaatttttgcagaataagtatgattatccccattttatagatgaagaaatcaaggcccagagaagttcaattagttgcctaaggccatacatctggcaaatgatagagttaggagttgatcccagatctgcctgattctgaaccctttgtttgatctttgtgttgttccatatcatttccctatttaagaaactcatttatatttgcactccataaatatcaagcctgtcgggactaagttgtaatgagttcagcatcaattcctgtttactggtctgggctaaacagtgctgatagtaatgctcatgtgaccactgggaaaggtccaagttcatgctctaatatctgacaacagaaactactcccttctagagaaaagagcagacctgaggataccttgtgcaatccaaagtcaaattccctattcattcattcattcttattttgtgtgtgtctctctctttctctctcttgtgcacctatgcacacacaatttttggtcgatgcacaattttaaggtcatttttaatctaaagaatttgttcccctcttctttcctgattacatggccatacagcctgccccaaacagtatgactcactctccatgactcttctgcggctctttgttgtgagttttcattttgtgcctcatttctgaatatgctctaaagagcagggatggcctttggctagaaagaatggcatgtcaggagggttccacaagccatgttgcttttctgaatcatgaaaaggcatcagcactcagtgacatggcccagttttctaatctaatttaattgaatgtacaatgatgtgggcactggagattaaatacaaccccacttctctgcaaagttcacattgcctttaaagcaatgtaatatttttttcatttcttatgaatggttctgtgtatgtgtcatgtatacttttacttgtattctctgtgcaaagtgataccttaaaaattatctgtaaaaagtctaatataacttggtcttctggaatatggcctgatttaattaattgaccaatattactttaaaccattatattgcagtgaaagttttttcttgtcacagtaggaactagagacgtgtcctaacaaagtactaacttatttgcaactgatataaagtgaattaatatatttgttacttttaaaagagagtgtattttggaattttgcagttatttgtatattaaggcccacattaagggcctgcccatttataaaatgacgggtaattttcccaagtgctgataaaatattttatcatctaaatttgaaaagaaaaagaaactaattttaaaacatttctaatttataacattttgtgactaacttactttttatttaatttatttcctttcattcccctcactgtgatccaatttgtagacaggcaggcttgctaaatagcttcagcatttgggtttgatttactgtgaagtagatcttagaaattaaagtttcaggttgaaatttgcctttcagatctccttgcctaaatatacatgtaaatttgggagtaatctaacatgtgcataaacacattcaaactattttatagctttaaaaaaattatattgaaataattttagacctacagaaaagttacaaggttagtccagattttgatacccccttcacccagattccccaaatattaatgttttactgcatttcctttattaatcttttttctagaaacacatacacacattatttttttctgaatgtttcagaataaattgcaacatgatgccccttcacccctgaatacttaagtgtgtatttcttcaaaataagaacattcttttgtataatagtacatttatcaacattggtaaatcaacattgataaattaccacttaatctatagactttatttaaattttatcagttctcccactaatattctctatagtaagagaaaaaaaatcccagcccacatgttgcatttagttatcatggctcttcaacctcctttaatctggaacagttcccctgccaaaaatgcatatcctgaatctaatcatgaggaaacatcaagcaaatccgcattctacaagataatttacctgtactctttaaaaatattatagtttttagagctatagtacatctccaagtaagcacataggcatatctacatttttaattttctctaagaaagagcaacaattcaaaataatccccaagtatgttttaaaataaaggcttctttttgaaagtcaaagacaaatgctcttagcctaaggtttcatttaaacatagaatggctatttcaaaaaacagtattacataaaatatgggctgggtgcagtggctcacgcctgtaatcccaacactttgggaggccaagtcaggtggatcacctgaggtcaggagtttgagaccagcctggccaacacgatgaaaccttgtctctaccaaaaatacaaaaattacctgggtgtggtggcgggcgcctgtaatcccagctactccggaggcggaggcaggagaatcacttgaacccaggaggcggaggttacagtgggccgggatcctgccactgcactccagcctgggcaacaagagcgaaactctgtctcaaataaataaataaaaataaaatatgtattatataagttagggacaatctggtctttcatatatagacttcagacaattggttgttcattctggagttgagcactatttctctcatgggctcttaagctaagaacatttagctacatgtcgggtatgtttcttacattctgcctcatgaccatctcccactgccatgcatatgacaaagacacttaactctgagccccaaatctagaggagagatctaaatgtcacgtgaagttcttaaaaacctttcttctgaggagttaacaagggatattaggaagattcctctgcccaaaagacctcccaaataacctctgccaactcaggctgcattaagttaaaccagatctgtctgtaaaatagaaatgagaatagctaataatatcaatatttcatacctttattttaactactcttctctggctactttgtgggttgtgagggaatggaacattttactgaggagccaggtgaatgaaagaagacatgcagagcaagaggtctttggtgagagggcctgtttgagcccctactcaagggaattaggagtagcatgagggccctgtatatccacagaggacattcatttttaatttcctctaagaaagaggaacaattaaaaataatgcttaagtatgtttttaaaaagacttttttttttttgaaagtcaaagagaaacgttgttagcctaaatttttatgtaaacatagaaggtgattttaaaaagccattaaggaggcaggggagaggtatgaaaaaatagattgaaggccacctactttacaattttgcctggtaacaccaaactaggcagccaaagcctggcttcaggtttgtcacagctatcggttatgataaacaatattaccatcacttcctggttgtagtctgcatgaatttgaaaactaaaatttgcagtgttcgggagtggtggctcatgcctgtaatcccagcactttgggaggctgagacaggtggatcacctgagatgaggagttcgagaccagcctggccaacatggtgaaaacccatctctactaaaaatacaaaacttagctgggcgtggtggcgcacacctgtaaacccagctactcgggagattgagttgggagaattgcttgaacccgggaggtggaggttgtagtgagccgagatcgtgccgccattacactccagccagggcaacaagaacgagactccgttttttaaaaaaaaaaaaaaattaaaattaaatttaaaaattaaaattaaataaaatttgcactattatgattcagtaaagcaggaatgttataattggttgttttctccttttttcctctgtaatactatttttaggaggatctaggtagatatctcactctgattattcccgaagtatgaagtctcccatactggctatttacatataacttaattcataagacttttaagaaatctctttttgccttctccttattctccagactggcattgtgaagatgagagccaacaaattatacctcaaagtctggaaaattagtcaactgttccacagttgtgcatgaaacatttctgactttgtgatttgtgaaagtagcactgactcagctaaggatcatggaaagagcatagacttagatcagaagactcattctagctggtaactgtgtgatcgtgatctgatcactaagactctgcgagccttaggagtctccccttgcatgaaatgaagttggtgaactagatgatcttcgcattatctcctaagttgtaaactcaatgattttgagtataggaattaacaaagccacttaaggggaaaaaagttcccttcatttcttgatgaaatacttattgagctatgtaccatattccatagaaaggaaaaactagatatcttaaccctactaagttgtttagtgaaaagaacatgaaaagttcagatgaaaagtcaagaagtcaacataggaaaaaacagataaactaataaactgaataagtaagtaatacagcttcaattaagtactggacttccaaatggatggaatcatacctttcagggctaaattgtatttgagaatacctactctgaggaataggtttttatgctctggaatcaacacctcaaaattcaacatttaattcatttcactcttcactcattactcttttgtttttgaatatacacatttttcttttttttttttttcctttttttactataagataaaccaaaaataaatggctaggtagatggctggagtttgcttgtttgttttaatgatagtataactgcatatagaaaagcaatatatgtgttcctatatgaacaacccaaaagaaaaataacttttaagtcatagaactttgaaggtctgcaaatagttgttgacttagttattactacgtgtattagtttgctagggcagttacaataaatgccatagacttggtggcttaagctggataaattaatttcctcaaaattctggaggctagaagtccaaaatcaaagagtcagcaggtttggtttcttctgagccctctgtccttggcccttctcactgtgccctaatgtgactatccctctgtctctatgctctgtgtactaaggacaccagtcagatttaacttaattactactttaaaggccctatctgtaaatactgttatattctgaggtactgcaggttaggacttcaacatatgtatttggggaagacacagttcagcccataatactgcatttatctttataataaggaagaaggatttatattattctactgttttgtgtgctgaatgtatttttaactttggttgtacaatttcccttacacctgcatcagcttatcacattgtgccaaggatgtgaaatgaattgcttcaaaatacaccctaattaattaaatattcacaacatttttatagcatttgatttttttccttgttaaacataacagagaattggatgttgttcacataccacagataagccaataaaccagacattttgtcatactctgtattgataagaatttttttggcatggaaatgatgtattttattgcctttaacttctaatacccccttaattacaaacataatggatgttttactggggatattgtatatgcagcagttgtttaaacctgaaatagaaatgctaagagggaaaagtattcaagtccagtgtagcccaatgctgaaagataaaattgcagcttttgacattttaccaaattattgattgtgttctctggctggctttaaaaaacttaatgcagtgagtaggttaaaaaaaaaaaaaaaaaagaagaagaagaagaaaatggctgggaaagcataaaggcaaaacagttttaaaaaagtatgagaaagcttaaggcctaactcaaatgataagcagtagattttatggcaatggtgccagacagccggggtttgtatcttgactcttcctacttaataactcactatcaggcttgatgtgataataaaataattcatgtaaagcactcagcacatacctggtttatactaaactcaacaatttctagttatatacatagatagacatacactagtacatgtgtatatatgtatatgtaccttgtatatgtatgtgcatatattaatatatgtatgtatgtattcatatacataatatgtatacatattcacattcattttcatattctccagcctccgtttggtacactacaacagtgtgtgtagttgaactaacagctggttctgctgtcatgatggctagaacagcaaagtcagccagagaaaccagcctcaaatggtacatctttctgtaagcagatatatatgatctatagcagcacgtccagtgattgcctcacagatactacttctaacctatgggggaatttttgcatagaaatccaaatcccctcctacctctcctctcagtgcttgagcaatctcttgatacatataaagctttgtaactatccttaagtttttctctggtctacatatggcctttatgcttaactcattgttaaattctcacaggacaaaggctacatacattccatatataacttcagcagcatctgctataagctttcccataccttatacactgaataaatcatgaaggctgatggaatcctgaaatgaacccataatccaataaaatgagaaaggctaaagacctaacctgctctggactcacattagtctagaagcttcaggaactcactgaaaggcaagatagaataatggttagtatatggactacagattcaggaatacctacatttgaatcctggctttgcaacttatataacttgggcaaattatttgacctctctgtgcctcattttcctcatctgtaaaatgataatcagattatatgtttcccaaggttatgaagaataagcttattcatatttgttatgtgcttagattagttcctggtacaaagtaagtgatagcacttactataagtgtgtactacataaataaaataaaataatgcctggtgtctcaacgctggcccacaaactagtctactctacacaggtcttccagaccaagagtgactataaacctaatagacatctctcaacaaggcagctgtaggtctttactgttcatgttgggttttgccagcagaccaagtgttatgaattggctttagccaagggtttcctgaagagattaaaaaaaaaaaaaaacaggctggtggaacatttggtatgtgtgtttctttagtggtttacagtctgtgtttctagtgtctgcatcattaatatatttctctttctggatttagaccctgtcattactcatctgtgtctgttttgacttaaacccatcactggaagaaagaaagaatatgggtctcaatgagttctattgcttcattatggtgataactttagtgcccacaaggaaatagttgcatacccactggctgcaaactaggtctgcattcttcaggaaagatgttatatggcagcctttaagaaatgcagtcttcttttaccttcaactttgtgtcttatttcactctacagtttttaagtgaaggagataagaagaaagagctagctgcaaaggtgagagttgaaatatttttacagagacatcattataatgaacatgatggactgtagttgtaaatagggtgagtgggagaaaacttgaagaaagttagaaacagatgaagaaaaggatttcagataaaaatcagggaaatcaatgtcagtatgggaaaaaagatagtaaggtagaaaaggaacttttaaatgaaaagaatgagtaaaagatgattttatactgattttaaataaaactctgtgtcaaagccttttgtaaataataaggttatagatgattgtcatggtggttatgtttgtttagcaaagactacattaatgaaatggctaagaagcaaaatcttaccaggttttaaatatgagtacactgtgtctattgctctaatttttgttacaaacttaccctaaaataggtcttttaggcaacaacagtaatagcgccaatcgcagttactctaccattctaccacagaccggggaacattctcatgaggactccagcattagatggcccattttagggcacaacacttcagccaaaactttggtagagaagcagtttcagtgagtcattcatgatcctaaatcttttggctgtggcctcaagatctcccctctgttcccagtgggaattatggtagagagacacagttaattgcctgtggattttatgactgtccccttccctgcagccggaatcatcatggaattaaacatgcagggaggttatcaagggactctctcttatgcggactgagaaacttaggttagaccctttgaagaattcactggactgaacatagagtctctactgagtaaaaggatctcctctgttaagttgttcatcatccatttatttattcattcaataaaaatgtattgggtgctgtatgagtttcctagagctgctgtaatatattaccacgaactgtgtgacttaaaacaacagaaatttattctctcacatttctggaggctagaagtttaaaatcaagttgtcagcaggcttgatttcttctgagggcgctgaaggagaatctgttccatgtctctctcctctctcctatcttctgttggttcccaacaaaccttggcattccttgcattccaatttctacccccattgtcacatggccttcttacctctgtgtgccctctgtgtctccaaatctctctcccctaatgacaccagtcactggattaaacttatttccaaatatggctacattcataggtaacaggggtcaggacttcaacatgtattttcgggggacacagttcaacccacaacaggtaccttttttgtaccaaatacaatcctaaatgctggggatagaaagatgaataatacgcggtctctgaactcaaaaacgtcatttaaataggggtagacataaatatacaattatagtgtcacaaatattaaattatatgtctcaacaaaatgctatgggaacacagaaaaacagggcaactaacattgtctcaggaagcccaaaatgtttcactgtgaagctgccttttgagttatagggtaaaggatattggagttcatcgattaattcatagttgtgagtatgcaaagggcattgcagaggaatggaaaaatatgtataaaaacatggtatcatgaaaagactttgtatctttcaagatagggaaggagttggtgtaactggagtctagggttagttgtagggagcggcagaatacatagaagagaataaacaggagatggtagacggcagaggacctgtacaatttcatctcaaagaattggggctttaggccaggcacggtggctcacacctgtaatcccagcactttgggaggccgaagtgggcagatcacctgaggtcaggagttcaagaccagcctggccaacatggtgaaaccccatctctaccaaaaatacaaaaattagctgggtgtggtggcaggtgcctgtaatcccagctactcgggaggctgaggcaggagaatcacttgaacctgggaggcggaggttgcagtgagcagagatcgtgccactgcactccagtctgggcaacaagagcgaaagaattggggctttataacatagaatgtctctgccaagactcttggggatgtgttttaatccttaaagtaacaataaatgtatttaagtagtagtataaaacgaagtgaaacagtagttaataaagcatcttgcaaatttggaaaggccattttgattttgagaaaattatttgaattatagaataattttaaggaaatgctttttaatttatttttaggatgcataggagctcaaactaagttaacaagattcagtcatccaaaccattgcctagtaggtgtccttaaggacccagtcttaataaacaaatacagctaaattataattggcatatcaactgtatgtaaattgaagcttataaagtacttgaggggatttgacaagtttgttctcttaagcattttaaatattactcatgttagttatactatttattatctatggggaaggagtttgctaaaccaaggtaaatgtcaatgctagttcctagacaactatcatgaattctgaattagtcactttttatttattcaacaaatatatattacttaacatctacgaacgagattatgtcctaagtagcaggaattcaaagacatgacaagggcacattcatgtcctcttataactcacagtctagttggggagaccaagatggaaacaaagaaacacattaaagtttgttgagttagataatggtggtgcatacagggtgcttgggtgaatgcagtggaagacccaactctttgttgaagaaggctttatatttagcttgcgaactttgaaggataaaaagtggttttcctagaggacaaagaaactggacagtgtagtgaggatccaagggatcaggcacaatgctttaaaaagttaggagaaatgaaggctaagccaaagtcccagaactgcaaaaaattaagtccgtgtggttttggttaggatgagaggaggcaaggtaggagatgaggctggggggttggccagcagccagtaaggggtctcatacaaaggagttagaacttttatatgatgtacgatccactgatttaagcagaagagggccatgatgaaattgggttttagaaagagacctctgggaacaatttggaagaagaaattagagcagtggttttcaaacatttctctttttttttaacacagagaaaacttttctaaagaaaatcttacatctaaccaagatagataaaataagagtgatatttctttcaaataaatattatgcaaatgaaaacaggctacttcaaactcaaaagtgtcaaattgggggttatagactacagcacctgtgttatattagactcagtatcaaaattatatctgtacacagttagttaggaattatgatggttcaactatttttcaactttacaatggtgtgaaagcactatgcattcaagtagaaattgtacatctctcatcatgctgggtagcaacattgaggcttagctcccaatcagctacacattttcagcttctgttgggtttatcagggcgtaaccccattgtaagtcaaggagcatctgtatttattaccgtactatattgagacaattctgattttctgtaataagttgtaaacaataacggttcaaatgactctccctgtcatgtcatgaaacccttcagttgcattggtctagaaatataaaacagtccgggtcgggcatggtagctcattcctgtaatcccagcactttgggaggccaaggcaggtggatcataaggccaagagatcaagaccatcctggccaacacggtgaaaccctgtctctactaaaaacacaaaaattagctgggcgtggtggtgcgcgcctgtagacccagctactcgggaggctgaggcagaaaaatcgcttgaatccaggaggcggaggttacagtgagctgagatcatgccactgcgctccagcctggcgactgagtgagactccgtctcaaaaaaaaaaaaaaaaagtctgatagtgggaaaaaatccctaacaagagtcaccacaactcacagtctttactgtaaatataggcattcaaaactttcttaaaatgctaaaagcattcatagtgtagtcttacatgtctattttatgtgttcacttttcgtttctacgtacacggtagacatggtaaatatctgttgaattaaaatgatcaaaaacaaagtaaagatttaaccaaaaaaatacagacaatataaaaccatgaagattcaaagtcaaaagtagctatagtctctagcaaggcagatgttcactggcatttgtcctctggtctgacttccagccccaatttatataatcctgacctaccagaaattgggataggtatcacttcatggaaaaagacatcatgctttaagaaagaagagacacatataaacttgtatggggttagaggagctatgtccctctctagttccattagaaattgctgttaagaagggttgggagcaaacctcttccaatcctacccacgtctcaaggcctagatcaaatttcacggtctctgtgtgacacactgatatctcaacacttcctgaaggtgacccatatgccaggaacagcactagatccagagatacaagtattaaaaagatccctgccacctctcatctacatttctagcatctgtttttactcatttgccatttgatcatttcccatctgtatacaagactttaaggcccatgagagcaaagtttctgtaagtttaattcaacctactttttttggccacaagctttgtggcaggcgccatgttaggtattaagaaatacaaagatatagaatacaagtcctccagtagcttgcagtataccatgtataaacctcagatggctactaccgtatacccctcaacagccagttagctgtgagagtaaattgtaaattctttcatgctctggccagatttaaaaacatattaatgtgtatattcttttccaactgtgtcttcttttttttttagatggagtttcactcttgtcacccaggctggagtgcaatggctcagtctcggctcactgcagcctctacctcctgggtacaagctattctcctgcctcagcctcctgagtagctgggattacaggcacccgctaccaggcccagctagtttttgtatttttagtagagacgaggtttcgccatgttggccaggctggtcttcaactcctgacctcaggtgatccgcctgcctcggcctcccaaagtgctgggattataggcgtgagccaccgtgcccagcccaaatgtgtcattttagatttcactttcttcttgagaccatgatgatgccacatgagaaatccttaagtccagctccaattatactgcatatcctagaatggaccattacattaacaagaattttcatatgctaaccatgacatgtacttcatatcatgaatgtagatggctaattttcacacattaccatgcatttcagcattccctagagttatctgaagcatctggggggaagggggagagaacctttaagttttctgcttctgagactattttgttgttattggatatcgctttgacccccttcttttagtgcttatcactaggcatctgccgtatttaatgatgtgtgtcatttcatttagtatcactgacttggatcaattcctcttccaggtttctgtactgtcttgatacatgtatttgttttgctttgaaagaaaaatcaacaattgaattgccagtgatagacatatgagtaggaccattcttaatggatatgtagagataatttctcttcctttaatgtctgtgaattatcatccactgtgatgcatttaaaaatgcaactcaacaacagtagtctactgacaaacaggtgactgctgcctgtgatgtgttttcagttgttggcttttctaagtagttacttgtcagagagaaaggaaaaaggatgaaaatatccattttgacacctcttgaaatgtgtttgttgactgtctctcttttaaatcgccctgtacctatttggcatcactaatcacaatgctaagtgactttttactttactaggcattaaacttgtgctgcttaacctttgagcatcaaacaggcctttccccagcaccctgctgtatctttagtacaaaactcctgaatcattatccatcttgaggatctgccttgccttagaggtactctgacatttgctaagacttcccattggaccttgcagacatttccagatcatgacagtgtcatttgatattttggttttaaacatcatcagagtggcttgtgctgaagaaccagaactagaaagaaaatgtaaaatgaaaagaaggctattgcctctgtgctgattgttaagatggcattggaaacatttttgtttttactatggatatagtcataaaaccatgaatatttttcaaaggatcacagtatgaaatacagagccaacggtagaatatattaaattagcccatttgaaagagggtctatctgtaaataaaccttgcagttaagaaagccaattatgataaaactgtatagttacctggtaaactactgtttataaactactttaattttacaatatcttatttgaaccttacaagaaatgtgtgaacatagtaaggtagggttactctcctcattttgcaggtgaggagactgagaattagaaaggacatgtgatggccgggcgcggtggctcatgcctgtaatcccagcactttggtaggcggaggcaggcggatcacctgaggtcaggagttcaagaccagcctggccaatatggtgaaaccccatctctactaaaaatacaaaaaaaaaaaaaaattagctgggcatggtggcgtgcgcctgtagtcccagctactcgggaggctgaggcagaagaatcacttgaacctgggaggcggaggttgcagtgaaccgagatcgcgccactgcattccagctgagtcaagatcccgccactgcactccagcctgggtgacagagcaagactccctctcaaaaaaaaaattaagaaaggccatgtgacttactcctaatttcctggcttgcatgaggctgagccagaatttgagcctaaagcttctctgagtccaaatttggtgttctctccactatatcgtgctgcttctacttatgggattgggaaatattcgggaattttaattgacaaaagtgaactgtgttcaggacagaacttaaaactaaggtagatattaagggaacaccctatagttcaatgggtgtttttctaggctatagatgaggagaatgccaaggttattacctactccaacaccaccactttgtggtacaaattaacaaagataccccccaaatctatgtatggttggcttgcacaaattaactttgtatttggcaaaaataaaaagccctcaggataatatttcccttatgtagtaaaatagctataatagaatttcacaatctttgttattttctgttgaaatgtccacaggaaaattagaattctgctaattgattttttttctgtatttataataagccctcatacaattgaagcatatctgagaaaactagaaatctattttatttatcttgtaatctgaaaagggagtgttataaaaattaataaggtttcctagagtaggaaataaaaattttaaaaatgaagtaatgataaacattaggctctttaaatatatacgaggcatatagaattacaaatcaacctggagagaccaattggagggaatgatgacaatgaaagtagatgcattttaggatgtttggcagattaatccttcagttttatcccttcagaggtatgagaggtcagtagcatgtctaaatgtaggcttatgttatttacttttcatcatcactgtgaggaagggtgaattttttaataaaaagaaaaaaactatcatagcatggagcttgctttttttaattggcagataattttacacttaatatttctctctcagctccatacgttatcagtttaattactctgaggcctcaataaaaaaattaaggaaactaaagtaggagagtttgcagtttacactcagctgttctgagttcactgaaagtgaaatgccaagctgccagggatctactgcatgaagctctcgtgaggctcctgagtgggccgagaagtggcagatgagcttcgtgtggatacggtaaagcatttagtgaaaaatgaaagtgaaagaagctaggctgcattcacaggctggcaggctttgccttctcagtttcaaacttgaaaaagggatctaggagtgactggtaaccattctgtgaaaaaaaaaaaattagctcaggaaggtgttgtaatcacaatggtccacactctgcagatcagtctcaggaaagagattggcatcctaacagaagacattctacttccttagtacaagattagggtcctccagacaggatgaattattgcaagtaattctgattgctgcttctgtttaaaaacaggctgctgcatcaggctagagaaggccctttgtaatgaagtaaaaatgggtgaaaattccctgttatgaaagaccaaaacaattagtgctcttctcttggaaaatataatagttgagtgagaagcttcaaagagctgcctggcccttccactccttttgccatgtgaggacacaatgttcatccattctacagtgtaaggatgcagaggctatgctcagtgtttttgaaatcaagaaatcataaacatttggataggataaatgcaaacctatttaccaaacccaagcatgttgaaaccttaatctgttcaggctgctctacctgagactgggtaatttgtaaacgacagaaatttattgcttacatttctagaggctgggaagtccaggatcaaggtgctgtcagatttaatgtctgatgagtgtttgctctctgcttccaagatgacacttcttgctgtatcctcacattgtgaaatggacaaacgctgtgttctcgcatagcagaaggagtagaagggccagggagctctctaaggcctcttttgtaagggcattaatcccattcatgaggatagaacccttatgacttaatcacttctccaaaggtcccacctcttaatacagctacagtaagaattaagtttcaacataaattttagaggactacaaacactcaaaccatagtaaagggtatctttgaagcattgcagaaacaaatggggaaagggaagtaccatacatgactcacagaacaacttatcctggaagttctaaagaaatagcatgtttaaaaagtgaagtgattcaggtcaactcatgcactatagatacatggttgctttgtaagagaaaccaaggaggaaaagccatcctttctacaaagcatcccttggtgactcccaccaaaaatagaatcacaaggctaaattgatcatgaatttggtattcttcatggctttagttttaaaaatatttttaaagtattaaaaggattagtattgaagatagtaatactggtaatggtttgcaaagcttcttgttcttgtcctactttggactccacctgcatttacacaaagtaccttcctgtcaaagtcatggacctagaaatccaggcttagtgcttgtggatgccatctggtatgggggtcagcttacggactttgaaactccacagatgtccaccacttattaactacatgatcttatgcaagctttttaatttcttggaggcttactcttctcatttgtaaaatggttttataatacctatcatacgggatccttttaagaatgattgacgcaatatatgcaagtcacttaacacagtgcatggtatccactaaatgctaagtaaacagcagctcttactattgttgtgagctaagtgagctatttatacaaccctggattcaaaaagttgtaataaatatggtggataaggtgagcccacattttcctaataaaactttaaaaaagttttatgaccattttgagtgtagctggacttttagaaatgtagacgaaacagtgaaatgtgtagttatgaaatttaatttgtttagttatacagatatattcaaattgtagatgatgcagaataatctcttcaggtatgatactttgcttttcctccccactatctcattttgtaaaacaattctattgaaacttcacgcgtatctctgacattggtgtttctagaagcactggagctaatttttgtgtcatctaacagttttccagagcatattacattcatgtccacctaagtttttagagatacaacactttaatctgtgtatcagagtatcaatgtcaggctttttccgcaagccacaaatactcatttgcataccactaggtccattggcttttccattcatcttgcatgtgtatattggtgatcttcgttaggtatttactgcagggaaatcttaagtaatctttcaaaggcttgtttacaatgatctccaacacttagtactatgacgtcacaccctgtaaacaattaataggtctgtgttaaatttcattatcttaactgccttccccaattttgtacgtttacatcataagcatctaaaacccatattaagttgttccagactaatgcgtgttttccagagagtacattattaagaataatttggaaaatgtcccttggaattaagcacttgaatgtaagacatcttcctctttttttctgcgagataacttgtagggagcaacgggaaggtatgctttatatttgtgaggataggaatagagattttcttgaaatatttatccaattatatgactttaaaatcatgcaagtttcttatttttattcatcgtatatatgtattaaatgccaggatgatccaaacacatagaaggtgaagttcctgccattataggaatttttggaccttagagaatatccaattccagaacaatgcatggaatactttgtggaaagcatttgcagagagaaagctgtgagttgcagcccttgtcctcaacaactgacagcaaatttgtcaacaaatttaattatgtttatatcaggcagaatgtgtttgaagggcctgcacacgtttcacatagggaaaagaaagaggtgaagagagaaatgttacatgtaaaaaattttacatagtaaatcatcacatggaaaaacacatttttcactggcaagtaaagaaatacaacaacaaagtaacaggtagcgacatatatgtattgtgatggctaagcactaagtgaggtgttggagaagctgtagagaaacaggtacaatttcaaggtggtgccgttaggtgacaattcatggaaatgtatacataaaacaatgttaagtgaaagaattagatcacaaaagagtatataaacgctgattatatctataataatgtgtgtatgttgacatctattgaaagaggatttgaaagaatgtaagtttaatgttgatttgaattttctctctgtaacagtgatttaaatgcatactaatttgaaaagaatacaatgaaaaatgactccccatcacacccctaaaacacataataactacacacatcttggtaaatagattgtggtagaatatgatgttcattgtttgtgatgttgcaacattatctataaatcaaggacttaattgaagttgtacttcccttctttatctactgtaagtctgatgaagcattttttgatcactgtttattatagtaatgagaaaagaataaatcttttccttataaatcctgacaatctgcattttaaatccttgcacaacctgaattctttgtctccactaaatgaatacagaaagtttaagcctgtgattgccttatttattctgcctccctacctttcaatagctactcaatagctctttcttgacctttacctgtcagttaatagttggtacattgagatgtgtttattaagtccaggcagctaagattcagatttatatgcagctaatatgctgaatgaactgaagatctactatgtaccacagatctttgcctggtactctacaaaggggacttcacttgatcttggtagtaaccatctgaagtctgaactattatccctattctgatgtgacaaaactaagcatcagttcagcaggcagtcctcttccgagcccaggacagtggtccttcccttgttccattgtgccttttaagtggctagtctcagtgtgttatagagaatagtatagttttaaacatataaaataaatttgtaggaagcagcatatttttaaggaagatctttttaaaaagacaagtgtgttgcttttttcctcatttaaaaaactgtatattgttgctataaaatttatttataagagtggttggagggaggccgaggtgggcagatcacctgaggttgggagttcgagacaagcgtgaccaacatggtgaaaccccatctctactaaaaagtacaaaaattagccgggcatggtggtgcgtgcctgtaatcccagctactcaggaggctgaggcaggagaatcgcttgaacctgggaggcggaggttgcaatgagtggagattgcgccattgcatgccagcctgggcgacagaacgagactccatctcaaaaaaaaaaaaaaaaaaaaaaaagagtggttggaaattttgatacaaagcaattcaaaattatacaaacaatttgagtagaatccaaacatgaagcaagattttctactactttaataatttcaattaaataaaagttaggagctgataaaaccgtttgagggtttatttaaaggggagcatgttattggcatgctgaccaataacactgggaatgtaatgtatcatgacatgtcagataacacaaacaaggacagtttttggaaaatcataaataacaaaatagaaggagtgtaaaatggaagaagcatcaaggggtggttggtacaataagatattaactctgagaaagttttctaactcatcacttaacattatgaatactgaattgggatgaccacaatactagcttctgtatgactccttaaatattgatattggaaatgtgcaccacatgataaccaatattttaaggtgggggcaaaatagctgctggtatgaatctctagaaagattaacttgaaaactgtcttgtgtaacaaaaggaaaggagaacatctgggaggagaaaggaaatttcctagaaatgggaaatgtggccataatgtgatttctttctataacccatgtatgcaaaaacatttatctccttttactctagtcacactatgtttgtggcttgcatgagtaagaaagctagatgaggagataattgttcagcaaaagaattatagagttgaaatcagtgaagtgaatggtattttatagcaaagagatccctaaaagtaggtggcataaagaatagatgcaaaaaagtattgctttctcttcgagttctaaagacctctgttgatgacgttttgctcatttaaattccagagaataattggaaacagagactttatgcgacagagctttcatttaacttgttcacctgacagttggctttgaatgatattttattaccaatcaacctaaattaaaatacccagctcactgtaaaaccctgcagacagtgtctggaatgctaaaacacataccatatataaataaaattaaggtaaggacaaagattgacaaaagcaatgacagtgaacattaacatgatatcagcagctttgagcttctatcaacaatgtggaccatgatgaagttaccagagagggcagtatagatggattttctaacttgcatttatcagaagagattttcacttttcaatcttaactatgtcttataccttttaataaagatgtggtatcaaacatcgaacatatatgtctgtacctacatgtaaatatatatgcatgtgtgtatatgcatagccatagctatccatccatccatcccaaagttcatctctccaaggtgctagtccacataattgcgttcagttcttctctggtctttgtataaatgtgtacttaaggactttgtggatagtgcgtgatataaatatggttcaggcccatcaaaatgcagattataggatccggtgaacttttccttaccaaataactgaattcctgaatgttgtattattataaaattacaaaagtttcaaacttactgctattctctaattacttctatagagtgattattatatgggatcaccagatgatcatggtctgtcatgctattgctatctttcttcataaatatataatttatcaaagcttaattatattattatccaataaatgaatgatagaataattatggttatgtggttcattacgttatgtcccattctctgactgaagcctctcagtttcatatctttgttgtgtagactatttatgacaagttaaatctgttctctggaacttagtgtcatcgtctattaaaatgaagggttggatttcaattaaataattcataaatttcctgtcagctctaaaattctatgttccattgattatcctcaaactattatacaagttcataaggccttctaatatatatatatatatatatatatatatatatatatatatatatatattagaagatagatagatagatagatagatagatagatagatatactagaaggccttatgattagaaggccatatgtgtatatgtatatatacacacacacacatatatatatgtatgtatagtgttcagttcttctctggtctttgtataaatatgttttatatatatattttaaaacactatattaatgtgcatgaattgagaactgctgtggtatctaaactcctttctgcttgactctatgatgagagatgaatgaatttggaaatatttagtccaagaaaagaaaaagtgtggggataatcagtcttcaggtttatgatgaattgtgactagctttcactctcttgtaaatgatagacaaagagagaacaaactgtaccaaatctcagaatgcataatgtgatagtgcattaaaaaatgctgtagaagctggagatacttagggaaggtagtcatttgatgcaaaatatcagttaatctcctctctagtgtgctttaaagccagggaatctaaaatgggggaagccaaggaggagtagagttgtttctcactgttcaacaggaaggcactttatgtattttcttatatattaattatttctgagctatttctcctaagagaaaacccttagatttggcctacagaagatgtacttatcattggcctttaatgatacagacattgccattgctaccaaagttagtttatatgtacaaggttatatttaattagcttatgtagatcaaaatgcaaggacagaacctaatccctcctcttcctctgtactaatcaatttataatctgaatgtgtcagaattcagattatgaattatgttgtatctattaatccttgtaaccacagcacattttataaaaatatacatactttgattctaaatgataatatagtgcacgttcaaaaccgagtaagtcacagttggtgggcacagagacattggtaataatgggatcctccagctagcaccaagtctctgttttttctttaatgttatatgatgaaggtaataataggtggccagtaaggataaaaagccacccaagaaagaaccagtcttaaacttggctcttttgcttttttcaagttttctcataatatattcaattccatgtaaatattgcaaacagctgaattgcacacattaacctaaacatgaataaaaaatgttgatattttatttaacctaaaaatagtagttatggataggctgcttttatgattatcgtctttaaaatatatcattttacattgggaatatagggaggattgtcaccgttattgtataataagaaaatttgttttgagtacattaaaaatacagtagatgattattgcaatataaggggaaaagttgtttgcttttgacagtctgtcagatgtagcctaggaagacaagtatggtagctgctttatataaaacagtaggagaaggacacaagctcaaagaaattttacctagctgctgttattaaagaaattcttttatagaatagaggctggttttttttttcatctttccgtttttgcttccatctctgaatcctttgctttcatatggcatgcaaagcgtctgtgcatggcagcctgtaacttctgttatttaaactgccaactgttaaaatggattgagttgaaccagaggaggaaaatagccccactgaggcaaatgcatttttacacccttctttaataaaatattgtaaggtatagctagaaagtttccccttggactttcatctaaaactgttagattgtagctttgtgaaagaatcattgttgactcctgtcagacagttttggagaggaggtgaagaggcttgtcttctgactttctgtgcactttgtcaaatcaggtactttgagcagaagtacgaagtgaaggctgatgtcagagaatgccttgaagcaggaacttgtgctagtctcctgtgacttcctttttttttttttttaaggaatcagattggattgtaaaatgatgggaatatgactggacataaacacgttcattgcaggctcagcagccgttacatatcattagtgaagggaggcaaggggcaagggggaccattttgatgtcagtttcattctttttaaagacaaatgcattcactgatgagaagtaaaccagcatctgtaaaattttacagacaagtaatattttaatgccttcttttcctgtagataaacgtataacttttcaataatcattaatataaactgaaataatgagtaattgtgttaaatacccataatgttggagctgcttttaaggaaaccagttatgaagcaactgtaacatcaagatcagtatatttctgttccaaaatagtctgtttcatagactcagtacatagcttgctgttatgccacttcggccacagttaatgccaaaatctaaaattttaaaggtgataatgctttttaataagaaatataatttggccttaactttccccttataaaaggccatattccatacacatcaactcaaaagtttgtcccattttctgacttttctttttctttatttgccaaagaatctctgtaattggcttgctctgcaaagcattttatttgcccttctgaacattaactattttaaagatccgagtgtattatggcagggaacacaagattttacttcaaccccttctatgccctcctctctactaaattaattatttctgttttgagtgttccagggaaagagtaaaattgttaaggtataacaggtaccaacgagtcatccaaacagaagtgccattccaggaaagtacagtatctgtgtgcccagcatggatcttggccctgccctacttttaagcttctaacatatcttcgtagtcatttcttctgtattgtgatttttttttaagtgagcacttttagatgtcccatatggtttaaaccaaatcagaaattcatgtccttaatgtttcgttagtcagaataattaagttgatagttcggggagcagttgaagcaaaataatggggtcattgaagcagtcaagctctaatgggaacctgagctcattcagataccaaatctaataattgttctacacctgtatgcccagtcccattgagcaaattcacattaaaggtttagtggaacagtttcaatgctgtggtccaaagggacttgctactgttttcacaagaaagcactgaatattttttggcaatatatatatatattttttgtgatgtgttaactaagctctgtgcatgtatgttggtgccctatccctacctagagaggaagaaaagggagagatgtattttcaggaatgtttttcttaccatttagggttaataaagatactctcaagcatttgccacctggaagcaataatatgagatgattaaactcactggatagtttggggagagggggagtttggttaatctatgcaaccaactagaaatgaagttcacttaaccctttttcttcataaaataaaatggtatcaaggtatcaagcatgtttttttggggtttttttgtttttttttttgtttttttttgaggtggagtttcactcttattgcccaggctggagtgcaatggtgcgatcttggctcactgcaacctctgcctcctgggttcaagcgattctccagcctcagcctcccaagtagatgggattataggtgaccgccaccacaccctgctactttctgtattttcagtacagacagggtttcaccatgttggccaggctggtctcgaactcctgacctcaggtgatccacccacctcggcctcccaaagtgctggaattacaggcatgagccaccgtgcccggccatcaagcatgattttggttattgaagtagaaagtagcaattaagcattgtgtagtaatgcactgtttcatttctcctgtgtcactatatgactgtaacaacaaactgactgcctttgattctcctgtaagatatctaaagagagttgacaaacctaaaaaaattaaaggtctaaagagtggaactatgaatttaattctgccgtaaactgaccattgaactgacctatctccaatagaactccctcattggaggattcaaagcacacaggaaaattaaacgatttgcaatttacctttaacaactatgaaatacagatctgaccagctttctttatcaaaaaaggcaatcaaagctgaattcacttacctaaagaatagttctaatacacatgaaggtattcattcaaatgactcttgtgctctaatatttttatttcctttggggaattcaaaaatcatttaccaaatgtctcttatattacaggtaccaaaaaaaaaaagatttaaattgcagttgctgcctttccagagctcacgataaaatgggggaagatagatcgcacagggacaatcacagtataaagctcaagctgaatcttaacagatgagtaggagtttcttgggtaggaaaagaaaaaggaagagaagcatgatccaagaaagggaacagcatttatggaggcaataggagaacacagtatattcaaggaagagccaactgttaacattgctggaacataggtatgagaggctggaaagatgaatagtcatgataggccatgtataattagttcgattattttactacatgggtgataaggagccatttcaggcttagacttatggtagcatggctagatatacattgtagaatgattatcttctaacgatatagaaggctgatagggtaagggtgaggctagagacaggagaaattcaatagggatctattataagagcctaagcaacagaagcataaggcctgcactagagcagtgacagtggagataatgcagaataaatagatgcaaaaatgattcaggggttagaattgactgaacttattgagcaactggatatgaggataaaaaagggaaggattctcggatgatttattgatttattttatgattgctatatgatagctgtagtaattttattagggctgctgtgacaaagcaccacaaactgagtggcttaagccacagaaatgtattgtctcatagttctagaggctacaaatccaagatcaatgaatgggttggctgtgccacgctccctgtgaaggtgttagggaaggatatggcccaggcctctctcctagctcctggtggttttctggcaatctttggcattctttggctggtagaagcatcacgttgatctctgctttcattttcacatggcatcctctcttggtgtgtgtttgtctccaaatgtttcctttttctagggacactagtcataagggattagagcccaccccaatgacttcattttaacttggttacctccataaagaccctatctccaaataaggttacctcattctgctgtactggagcttcagagatccaatatatgaattaagggggacacaatttaacttataagatggctctaatcatcaaagttaggatatataaaaaggagggaataggatgaaaggaaatgaaatcagtttaatttggatctgcagtgtgaggtagctttggaacaatcaggagaaatattgagaaggtgattgaagctgtagcttagagcctgagaaatgcagagttgagatccattagcatgcaggagatagaatagttagagcagttaagtttggcaattggatgagcatacccctgggaagtagctcatggaaagtatagagttaaaatatgggaaagggcaaagaataaagtgctgaaaattactaacacgttgtgaccaaaccaaactgtgtctgtctgcacacaagcaatggaaagccaaacaccaaagcactgtgtttttgcagtgagaaagtttattgccaggcagccaagcaaggcgataggagtcaggttcaaagctgtctcccatactagccttgcagccatggatggatttaagggagagattttgaggctgggatctgggggctggacagtgattgactgtaaggaaaagggggttggaaattcccttgggcatgagctattgaccatgcacgcttcttcatgggtcttatgttcagaaaatgatctgagggtggagattttggccctctgacatcaaaaggtcactcaccaggcaagcaagtctattctgtgcagactgcagtcagacacattaatgggttccaacttgtcccagactgtaagccagttttgttgcaaactaagggaattgtaacaaagtgttttgttctctgttctcctgcaagacaagctcaagaaattttgctacttaccaaattctcaaggaaaaggatagtagcatagaaacagagaaagattaaagaaataatttgagaatgaagaaagaataataatatacaagctaaaagaaaagagagtttcatggaaagaataattgtcaacagtgtcatgtgctacagagaggtcaaggaaaatgaagactgaaagaaaaaaatgttaatactgactgcagaatgtgatattgattcaggataggccaattcataaacaaagtaatcatggaacataccctgtattttcaatagaatttcactctacttgttactagagaaaagaatgaatttatttatatagtataaaatttttatacttataaaaattatattttttctagatcatgtagtttttctaatccataagaaagtcatatctcctattttactgtctttcaaaaggtagttaaataatcctgacaaagggaatcgtttagaaacaatacatacaaattctgccttggtcttgaaattttgatatttatggttatggtattttgcgactaatgttcagaataggataaaatagggcatctcagaataagattataatgtggttggtcagaagaaagtcttctaaggaagtatctttcacttcaagtcattgtctgttttttatgtagttaatgctggagctctcagggctgctaaatgtcattttatgtactacttcacaatctaaccatacatattaaccttttccttcaacacccctaagaacagaaagctgtctctagaaccagctttaaagattcacagttagacccagagtaaaagaacagattgaaaagatagtttgtaaactatttattgtcctgcacgaatatgtatatatgggaacaaatgacatatttctatgtctataaatccttgtaaaagttttattcagagaaagaatcagcatgtatttactacatggctatttaatatcgagaaagctaataaagaggtagaagaggctcattctctgccatcccagaactctcctcttagaaaggcaatatctgaaatgatagtgagcagtacgaaattggctataattgaaagctgaattgtgtgaaacaagctaagtttgtgctattggagtcgagaggagagaaagatcagcgaaggctagagggatcgggaaggtgggatttgagttgggctttgaaggataagtagtcttgaatggaggggaaggagaaggcaaagtgggtacataagcacaaatctggaagatatatagatgtgtttgtggaacagttgtgaagccaacctaactagattcaagggggaatagtagagaatgggagaaaatctgattggatagagtgggatctgtgtaaaaacaaacaatttttaaaaacccagaaaatatgtactccatgaatctctcctgtacttttttagctgccacaaattttggggccaaatttattacacatgtattctaatctgccgaagctacatcctttagtgtgaatctgttcacttttatcttcatatgtcttctcttgcagtgaattttaatctgagtccctgaaagttaacttgttaccatttttattgttgtttttgtcttttcttcaccacttcaaattaggattgaaccagattagtcttgttttaaatccactgcagccttttgagctggggagtacggtctctttgagaaaactgttttctttctttttttttttttttttagaactaagcatttgttgcagtttattggcactgcatatttttatttttatttatttttatttatttttattattatactttaagttttagggtacatgtgcacattgtgcaggttagttacatacgtatacatgtgccgtgctggtgtgctgcacccactaactcgtcatctagcattaggtatatctcccaatgctatccctccccgctccccccaccccacaacagtccccagagtgtgatgttccccttcctgtgtccatgtcatctcattgttcaattcccacctatgagtgagaatatgcggtgtttggttttttgctcttgcgatagtttactgagaatgatggtttccaatttcatccatgtccctacaaaggacatgaactcatcattttttatggctgcatagtattccatggtgtatatgtgccacattttcttaatccagtctatcattgttagacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgagtgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcacatgagtaggttgcgaaatttttctcccattttgtaggttgcctgttcactctgatggtagtttcttttgctgtgcagaatctctttagtttaattagatgccatttgtcaattttgtcttttgttgccattgcttttggtgttttagacatgaagtccttgcccatgcctatgtcctgaatggtaatgcctaggttttcttgtagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttctcaggtttgtcaaagatcagatagttgtagataggcggcgttatttctgagggctctgttctgttccattgatctatatctctgttttggtaccagtaccatgctgttttggttactgtagccttgtagtatagtttgaagtcaggtagtgtgttgcctccagctttgttcttttggcttaggattgtcttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctaaccatgagcatggaatgttcttccatttgtttgtatcctcttttatttccttgagcagcggtttgtagttctccttgaagaggtccttcacatcccttgtaagttggattcctagctattttcttctctttgaggcaattgtgaatgggagttcactcatgatttggctctctgtttgtctgttgttggtgtataggaatgcttgtgatttttgcacattgattttgtatcctgagactttgctgaagttgcctgtcagcttaaggagattttgagctgagacagtggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatactggcctcataaaatgagttagggaggattccctctttttctattgattggaatagtttcagaaggaatggtaccagttcctccttgtacctctggtagaattcggctgtgaatccatctgatcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagaggtctgtcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttggtgctataaatttccctctacacactgctttgaatgcgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttctttaagaatgttgaatactggcccccactctcttctggcttgtagggtttctgccgagagatccgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcatttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacatagttctcgagctttggtcttcagctccatcagctcctttaagcacttctctgtattggttattctagttatacattcttctaaatttttttcaaagttttcaacttctttgcctttggtttgaatatcctcccgtagctcagagtaatttgatcgtctgaagtcttcttctctcagctcgtcgaagtcattctctgtccagctttgttctgctgctggtgaggagctgcgttcctttggaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggaggcagtctgcccgttctcagatctccagctgcatgttgggagaaccactgctttcttcaaagctgtcagactgggatatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaatcagcgagactcggtggggtagggccctccgagccaggtgcgggatataatctcgtggtgcgccattttttaagcccttcggaaaagcgcagtattcgggtgggagtgacccgattttccaggtgccgtccgtcacccctttctttgattaggaaagggagctccctgaccccttgggcttcccgagtgaggcaatgcctcgccctgctttggctcgcgcacggtgcgtgcacccactgacctgcgcccactgtctggcactccctagtgagatgaacccggtacctcagatggaaatgcagaaatcacctgtgttctgcgtcgctcaggctgggagctgtagaccggagctgttcatattcggccatcttcgagaagactgttttcaaagctggattagagattgactagaaaggaagaaagcctgagtatagtgattagtctacccaatgcattgtttctcaaattttaggtgtagtaaaagggatctgtggatacattttaatgagaacctaataattttgggtccccagtaatcgacttagacttacttttaatatattgttgcttaaatataaaaataggcataaactctatatgctttaagaattttaataaaacagataaaactaaaattaatgttcacttaatgtgcctactgattctagatttaatagtagagcttcagatccacttatacctttttttgaccttatcattacaaatgcagaacatccctgttgtataagtaggctgaacaaagtggtactagtaccatcagtcaacattttgtgatagaattcagggtcatcagactccataccaaatgaaaattttggtagagagcaactctcaaattccagttttaataggatgtctgctccagaaccttgtaaagttgtgttgctcacatgaagagaaggctaggattggaatataacatgggtatttaatccatttactgctggaatcaggaagcaaaaaagtattcagtacatatttaccactcaatttttagatagtgaacaattgcaagttggtccacaaggattacatccgtataatacaactgatcatgtcctgaagacggtactgactgttatgtcacagttctcatatgtccagcttgcctagactgttgtgtgaaagagcattgcaccctgtgatgactcaagtctctgaaaaattttctctcttcaaattatcatgaaaccttcattagtacagtgcacaataatgttgcttggcttttacgtaatataaaagcaaatatatataagcctttttgtatatcagtgatcagtacactagtcactcataaggtgatgatgcagggtatccttatgtaaacactttttactgtaccataaagtgaaaacacaaaactgtaaatataccctgttttaagaaataatgccctagtgagctccactgactttttttttttttttttaatgaaattggctgcaacattgggaattacatcatgtaattaatatctttgttacattgggctcttttagaacagaaacttactctggaccccttaagaaacaaaatgaattttacttccttctgtgtgtctgttcttttctatttatctttcaactggcttactgccctattgagtagtgcctttcatcacaaatcatgccatgtgttacctatgaattggctgcccctgaaggaaactgatgtccataatggtcccttcattggccactgttgagggggaaaaagcctatttagtactgctttcctaagtaaaaaaaaaaaaaaactattgagggtgatggtttcagctagaagtggtgttgggtacatcgggcacaatgacctgaggcaactgtttgcactctaagaaaatatcacccctttcagggtcatgggaaatccaagtgtaagttatattcattgcctccacttactcctcaaccttctgcaatctggcttctgctccccttatttcgaactgaaattgctctcattaaggtctctaatgacctccatatttctaaatctgatagtttgtctttattttactgcatctttctacaacatatgatattattgcttattccatttttcaaaatatctactcccctgaattccataacgtgtactgtaatggttctttctatgcctctctgaatatttgctgttttgtttcatggactcttcttcctatacttatctcttaaatgtcactgtttcccaggatttgatcattagcccactgcttttctcactttacgtacattcctgaatgatggctttgataaccatctaccatctattacccaaatctctctcactcttttcaggcctctcccctgaaccttggtcttgtaatatttgtaacggcctgctgggcaggtccactcagatgttttaaaggcatacaaattgacaaatccctaactgaactcatcatcacctggaatgcacctttttctcctatatattcttagatgatggaaccaccattctcccaaacatataggctggaaattttagagtgatcttggactccttttctttaattttagagtgatcttggactccttttctttcctacatgtccaatgaatccctaattattgtcttgtgcttattaagttcacctactgcatgatcaccaaactgaactgtcttaccacttcactccctattgcatatctgaagttcaagagccttaaaatgacacataagcccaatctgtgttctaaccatcatcccctgcttttaatcaatactgattttgtttgtcatcttcacacacactttttttacctcatattttctcttcctttcctcacagcatctccttttcctggaatatacttttcttccaggataattcatccatatcctttaagaatctacaacaatattgccttctctagaaagtcttcccaaagatgcttcccctaaggcttggctgagtatttaatttctgtactcctgaacagtatacccctcatcatagcacacactataactctcttctcattatctttgtatgctaaccgcatttgagagagaacaccatgaggcaaagggctgagacatttcattttggtatcaggggatccaatataatctaagttctcaaactgactcactgagaactatataacagagtaaagagaaagccttaatacatttccattagactaatttttaaaccaaaatgccacaatcactacatagtacctgccttgaaagactggctcatttatctctgtatccctctagcactgtgccaggcacatagtcaatgttcaagaaaagatggttgaaataaattgcaggccagtttttggacagagggaaatatgcctgacattggaacagactctgcttatgacagcaaggctcctcctctttcgagtgcataagtctactcaggaaaccgaattgaatttcagcaggttgcctggtaaatctgctgtcctagaaaaaaaaaaaaaaatgagtgaccggttttgctagatgcatcattcaagccaggctggaatctctagaaataatctctttctaccctaaaggacaaatctgtccagacaactggaatcctaaagcagcgaagtaatagaaagcagtctggcaacatttctatacccactggatgacaataagaaaaataagtaaatagttatgaaagattttcattgcttctcaagggcataaaaaaaataccctcgcctatgatgacttgtgaaatagagttagaaccttgataaattctgacttctggctgatctttttaagtctttgttttaataggctaatctgaaaaatacttctataaacatctgtttgcatctaatctcattgtcccaaaagtgactaaaaaatgtcatagtaccataatgaggctgtctagactttgaaaagtgtaatatgatcgtgatgctaaaatctttggaatttggctctcacaatatctaatatttaaaatgttcagctttttctctgtatcgggtgccattctggtcattttactttattgtttcattactaaagtctttgtaactgccctgttaggtgggtctttaatattatttttatgttcacaaggggaaattaaaatgagaaaaacatagctcttaagtggcagaacaaagatgtgaacccatatgtatggccatacactgagaactttgacctgtcacgctaaattgtgactatccattgtaagtagaaacagttttttgcttgaggcttgtttattgatttgtgtgcatgctcttcacatccatcagaagattagtatgggccaggtactagattacctcatttagttctgttaatactcttcagtgtaagtaccattattatccccatcttacgaataaggaaactgctgtttagaaaggttcattttgcgaatgcataaacgcaaagtgggcctaattggttaggaaacaaatgagtctagtagtctacattaataagttcaaagactacacatagcagttagctttactttgctccattgttataagtggtaagaaagaatataatgcttagtgctaagacttccctttccaccccacactgcctgcactaggaagggaaaattaacccggaatgcatgctttactaaacatcggtcagtaccttttaccatcaaaggacagactttttttttttttgaagtctcatgtgatttttatcattgaagtaaaactctctccaggtgatgtaatgacatacctcctattttttctggatttttacccatctgtttggagagagtcaatcttttagagagaatgactttttaagactttaacttttagaatttataatctaagatacgtgaaatacctttataaatgataactgtgtggacacaaatttattcatgttctaaaatttgtaagccatgactttcccatcagggaacattccacggcccttactgaaacagggcagaaaactggcacctgttttatatcctttttttctttccattatagtatacttagtgatggtataatcaacaaggaattagtttagagattattggatcctatgctactctttcttaaaattgaaaacaatatgtactttgtagctaaagactgagaatttaacatcctatctagattttgttctctagtttgacaaattaatcatgctcaatgccaaaaattcagatattatagaaatatatatatatatatatatatatatatataaaagaatcagatggttgcggtggctcatgcctgtaatcctagcactttgggaggctgaggtgggtggctcacctgaggtcaagagttcaagaccaacctggccaacatggtgaaaccccatctctactaaaatacaaaaattagctgggcatgatgacgggtgcctgtaatcccagctactcgggaggctgaaacagaagaatcgcttgaacccaggagacggtggttgcagtgagccaagctcgcaccactgcactccagcctgcacggccgagagagactccatctcaaaaaaaaaaaaaaaaaaaaaagagtcatcccaccattcatagatagccactattttttattggtgtatatccctctaaactttaaaaattataatattataaattatatttttttcaaaaagcagattatgacatactcttataacttgcctttttcaccttatcatatggacctctttttatcaagtacatgtagatctatgtaatagtttagattgactgcatagtatcccaatgtttgtaggttccctgttttgtctaatcccatgatggacatattggttatttatgatattcattagtataaacaatgctgcaaagaacatcagtgtatgatgatctagctttatacatttatccgataatgtgaggactggctttgtcccaatagatgtaaatgtcaggaatgattctttgagacatcttatatgagaagcaagttgctaggttagtagccatttttattcatgtataggctcagcctggcactcaggttgtgcatggattgtgttagacactagaaatataaaggaacttgtgccaattatgaatatggaatcaagaagctgtgttttaactgtgtcctaattgttcatatttaaaacaacttttgactggcttctaccttaagggacaatttgtattttaaaacaatggcaccgacagctgttaaagtgtgtgtgatattaaccatacaggttgcctttgttcatacaactggttaagtaattaagcacaggctagcatggggaacattgctaatgggaagcacctgtttatagactcttgcattgtaagctgtaggttaagtatcttttatcaaaatcataggcagtggtatatttctgtgatctggttctttgggaaatggagacatcatgcagggtgaatgaacgactgccatttctgcctcactgctgaaactagcgagcctgcatatcaagggtacctgggcttacttaagctggggagttggactgactaccctaaaacttccatcatcagcaagaaatacgtagcccagacccaagagatgggttgcacatgttaaaaacaaaaagagtagatacatggtcttagagtgattcagaaacaaaggcagatgacaggtaagtgtattctaagtcagcatatcagcaacaaagttcaggcagatcacaaacaactgcctcagaaaatgacagaggattgtccatcatgtgctcaaagttagagaaatggctgatgcctactattcttagtcataggcatatatgccacacatggagtagaaaggcacagagatgacaggtgatagtaatgaattgaccttgtagccaccatgccgtttaacagctagtttattctccaccaacccaaatggctgcttgagctctcaccctgccaaacactcctggcccaggttattgcaatctatgccttcatcggcttttctactgtcactcttgatactatctaggatatctaggcttcaacaatagaacctcttcggaagatttcagagagcccatttctgctcactttttaaagcagaactcctgttttctatgtaaatgcttcaagactgtttttttaaaaaaatagaattaaaattaaaattacatgtttattgaaacagctgtcactgtcttagttctaataactacaagtccagtcagtatattttatttcattattttcttccttagaaaataaaggttaaatatgtatagacattctggttcttcctttatacattcattgcttttcataccctctttgcaaataggaaacatttagtcattaaatagcaatattcgagaactagaattccctttttctgctaatcaaaaattaacagctatctttctgtttcttcttgttgaaatccccctatcttttaaggcttaactgggaagaagttgtccctgactcccagctcctgtactcaagggatatgatttttctccactttgaacctccattgtacttaaaatgtaatagatgctacaagagacaatatagttagtttcatgttctagttgttggtacatttatcctttctaccctcataatgtgcaagggtgcctgttaaggtaccctgcagatagcttatgcagtaacaacgtgtggatagacagacagaagaaagcctttcctttccttgtattaatgtcaaaatacattccctctgtgaaagcagcagagctgaaggtgaattcaaggatcagtttctgatttgatgctaatgattggatgattatttaatcaacagacaagtttctagaaactactatgtataagccactatcatagacaccttgagcatctctgttgtagtttgtgtggtttctgttagcttgctcttcaatatgtttcacatatataacttccttggaagctttaccagctattgcctaactttcttcatatatttatttgtcacctttttctgtattttctagatatgcaggcatcctcatcagactttgaacatcatagagagaaaatctgtcttacgacccaattgcattctctagtaaagaagcaaacataatgcatggctcatatacaaaaccaaggacatttaaaaaaatctattcactagctttgacattgagtccaaagataatcaatggcaaggtctgtggcagttgaaatactgaacaatatactgatgtaattttttcttaaccatacttttctaagatttcttgaaatgcccatgttatcaattatgtaaatgccagtcattcagaatcccaagagattggctgtacatgttataaaaatatcatgtttatggtagataaaagtaagtattgcatattttctacatttgtagtttaatgtggatacatttttaatgccttgaattaatattattgtactatgtgattttacttttatcaggtatttcaatcttcctaaagttactataattgagtttgtttgataatgtacctttacattagtacgagacttgatagtttgcaaaatatgaggttcataatagagatggagagtagagttactacctggcagggaggataagaagaaagtgaaatatagaaaagtgatttaatctcactactgcagttttgtaaaatctaatttgtttttcccctagcacagcagagtttcatgttgataacaagctactgaattaataaatccattgcaactattgagatttttcctttaataacataacgaatgctgagcattaagaaaaggaaaggcgttctttgcacagaagttacctctagcagatctacatccctatgcataggaacaataccaacatcataccgtgaacaatatcaatgtgaaagtaatttgtgcatctcaattagaatactgtattttctacacaaaagcactctgtttcatggaacacatttgcttattttccaattggaaagacatttgggggtctattttgttatcattacatgtgcttaactccaattacagttaatgggagtcgtgtgtctatagtcacagtagcctctgaactattttaacattattgctttccattaccatcctcgttaaaataactttcatctcttctaccaacctgaactaccacagtaatctaggtttctgttttctttgcacggatttatttgcatgtaatgaaggatacagattacacaacatgacctgtttctagtttgcacattataatgtcattgagattagaataggtctagaactatttaattgctaagtggaggtaatcgattggcttctagacgagtacccattgggtttgtttatctagctgtgttatttttaagttgttttgggattatagcatgtagagttctaaaatgtgtcctaaaaaatacatagtttaaatgaaaatatgagtaatggaggtttaactccaccagatattaaaacatctcatgaggctgaaataatgaaatcaggagctattggcacaaaaatatggaataatctcaatgtcaatggaacagaaacccgagtatagcaatttatatttgataaaggaggtaacatgaatcattatagaaattcatgattattcaacaaatagtgcaggaacagcccatctcctctttgtaagaaaaaaaagaaacaaactggtgtggaaacttacctgacattgtacaacaaaatgaattatagataatttaaatagttacatgtaaaaaaaaaaaacaagttaaaccttaaagagcaagaactcatatagttgaatgtttgtcacatgtctctggctagagaaggactttctaagcttaaaaacaaagaaacaaatcacagtgtaaaagattgatagatttagtttcataaaaacagcaaaaaatgaaaccatatattcctaaaaacctacaacacaaaataaataacaatcaacaagcaatcaacaaacaaaggaaaatatttctaataaatatttcaattgtttagtatccctaacatgtaccatttaaaataaaaacaaaagcagaaacctaagatcccaatagataaatgggcaaaagacatgatcagtatagaaaggaagacatatgaaacgttccacctaattagtatttgaataaatgcaaaaagaatgaatcagatgcaattttttcactttttatattagcacatttttaaaaagattaatacctaacaaagagataagatacacaaattcatatactgccaattggatttaaattaatacaactattctggaatacatttggacttacttttgcataccctaacaatgccacttctacatatggcatatgtaaagatgtaactgtcatgttccagaagtttaatgacatggaaaatttctacaatacaatattaaatgaaaaggtagaacaccaaactgcatatgtagtttgagctcagtatatatatatatatacgtacacatacacaaaagacactattctggtcacagtgaggagaaagaatctggtcaactagtagagcaattggctgtcccccacaaagagattaggctcaagcctaatttggctgccaccttgcagtcatttctggtgagtaaaaaactatttccaagtcaggatttctaaaatcacagagaaaagcataaataaaaccattttggacacaagggggaaaaaatgtaagtccatatgagatgatttcagtataacagtccaaaataaatcatctttctctcatcagtgcttgggatgcaaatagctactctatggacatttttggaagcaacataaaaagttttcttggtttccttagcctaagctgcaatagacccagacctctacttgctctctttgccagaaacaatgcctgaccactgatggtaaatctgccacattgtcactttcaaagggctttggagaaagcaaagctcattgtaaattacagagggtttcttttactttgttttctagcctactaattggcattaaaatgggatattttgtaacactatgtatataagggtcatagacttcgtttatgttatcctgctgtgagggactagtatataatgttaggtcaacactggtatctctacatgcctatgaagcaccatagggaaagaaacagccttcccctaggcaacaacagatggacgcctaaccttgtggggaatgaataatggacgtggcccttttataacagtttttttcaatcccaagtttaccgcctcatgccatattcaagatacagccttgtacttttggcactcgctcactgtgttagaggattgtttgcacactcccaggttacataatgcagctcgagtcctccagtctatctcatgtcacattgtgtttaagctttatctgtattgtgcttattccccagttatttcacttgacaaagtcttcggtaagaaggaaattaatgatgtagatttaggtgtggatctgaaactttgtgacatccaggtattttgtggatgatgtgctttgtacatagttgctgaataaatgattgcatgaatgaattctgaagcaatactataatgggtttagtccatttactgcaggactcagttaagaaggttttgagatgaatgccaaatcaatttatgcttagaaaaggcataaagcttcttactcatatgacagcagggaaagccttgacatctgtttgagctggttaacctgatattcagaagctgcagaaccatgtttaagctgggccatggttttatattcctttttagtgaaagatttgaatattacttttgttttggccacgctttctccataggatgcacattttcttttctttctttctttttcctctctttctttctttctttctctttctttcttttctctttcttcctttttcttttctttttcttttttcttttttgagacagagtttcactcttgttgcccaggctggcaatggcacgatctctgctcaccacaacctctgcctcccagatttaagtgattctcctgcctcagcctcccgagtagctgggattacaggcatgcgccaccatgcccggctaattttgtatttttagtagagatggggtttctccatgttggtcaggctggtctcaaactcccgacctcaggtgatctgcccacctcggccacccaaagtgctgggattacaggcgtgagccaccgcgcctgacccaggatgcacattttcatataactatgttcctgtcttcaaccttatgctttaaccaggtcactcttcatagtatcagaatctattcaccttcacatggggcacatttcaaagcctttgatgaacaaaaagaatctgttagcgcatgcatagccggctctggtagatttggaaggtccattttgggattgatttctcaggcttattgctgcattaaggctcatgtttacaaacattagaatcccttaatgaattcttagaccataatgtgttagtctatgaattaagaaaaatgaagcagatgaagaatatgacaaatcatgttaccccatcctccaatcaagcgtgtttttctgtatttcattgcacaatgtccccaacaagcatatatacacagacagaccctcctcttccatttttctctctttgatttccaaaaagataacaggcagattggaagggataccactacttgttaacaaagccctccatataatctcaggtaaatacatgtgttgtcaactattgactttttgaaggagaagcctgtatttttttcacttaaactatactagtattaggagaatgagactagttagaaaagtgaattggattcaggctgggtctcatggagctctcagatcatatcacatgagcacccagtttctccacctgtttccaaagaggacatacaatcatggccactatcacccaaattaatgtatatcacctctggcagcaatcatatctaacatttgtcctttcctcataaatgtgatgccaactatgagtcctgaccttataagggccaggccactgctttttccccattcgtttttaatactataaatataaaagttgtatttcaaacaattgagtgattttcaatctctgcttaaaaaacatgactccaaacgtggaagtcgtcatcattagattgctagccactagaatgtgaagataaatgaaatcaaatttacacacacacacaaacatgcagagtataagagtatatatatgtatatatatttgttggtttttaaactaaattagttttaacataaatacagagagttggaaataaaagatccagatcagccattgctgctattgtttctaatgatatttttttcataaacgttgtaggttgacattgtgaaaatgtaagtggcaacttttacagaattgcttcttataattatctcattaatattgggacaaattaggcatccagagaggtgtgggaggtggaggcaaagaaggaaaggagaaaggaataaagggagggagaaaatctagaataattctgttttgtgcatgtcaaaagctggatttaggccctgaactcaatgtttatcctgccttgcaaaagcttccatgtcttttcgtcagtttgttttgacccgaaactttgttttctcacaccagatgacaccagtaagttgcaggttgatgtgaagccttacatcccatcatttattgctgcaaagctgggtttttggatgtggtacttgtcttggacccagtgggtagtgagtgatggtgtggggtgccagtagcattactgaagtgaagtgtggatgcctgttgaccttagtgtgtaggaccaccaaggcacaagccttttttcaagtcagcatgatcctctgggaatgctaccgtcattctcacgtctggtagctttaacactgaatactttcatgctagcaatgcggtgggaaccattgtattgtaatctcatttttaaatgttttctaagaagtagaaaaccaatctgtatgcaaaccagtgacatctaagtaataagtcctttattcgggaatgttatcttcacatttttagctgaattgtgatccatatctcaaactaaataatggattttttaatggtatcttcaaaaggacacccaaataatccatcactcagatatatctctgagtagagaaaatgcctctttctttctcacctctcagtgatattattgcatcatgaagcactcagtatgctttaagtttatggctggttggctcaggacacataccgtggtgttaatgaggctggggtcatggaggcccgttagctttgctctgtttgctgaccacagactaccgggaaatcagtcaagagatgctagcacagacaagaacggcaccatggcaaaacctcagtagttctcagtttttcctccccatacaacaggcaggatgtgttagttgggcgtcatcatctcaaggaggaaatgagtagcagcttgggaggccccaacctttaactctgaacaaagcaggcctgacatttaggcattaactttgcattataatcccccatcataccattgatttgctgtgtaaccttcatcactaaagcagagataataggatagaatgaaatgggcttacctcccggagatgttgtgtgaattagcaaattaacgagtgtaaagtgttagcatttatgtaagtgctggtggttgtcattatttctagggacctagtctcattctaaatagagaatctaagtatattatgcttttgtcagaaagggattttcaccccacatcaattgcatttaagctgagcataaaacagaggtgataataacatagtagtgatcattgcaatgcagagctgtaaaccttttccctattaaagctagaactattttcagcaactttcaatgcttttaaactttgttttccaagttttgttatctctataataattattcttcctgtgatgggtggtgggaatgggacctggaataggtcctattcattattcattcccatgatgactatataatatattgaatttttttacatcatacaatcaagcaaatttggtagctagtgtgattgccacatattgcaatcattgtaaaaaataaaaactcttttctgctctgcctatgctggtgtcctctagaggtagccaacatacagattgaaaactcatggggaattgaagtgctttccaacaaaaggtgctgtatatagatcttttcaatttaacatctttaccaaagaattttgttgttgcctgctatttccaaggggactgtgcttgagagactgcttccatttcttttatcactctgacttcgcttaccaagaaaagtcatttattgctgattgcagaactcttgaactcagccgggcagctgccgcatgaactcctcagatctgagttccttgttacttatttacattttcatttgaagtgatttttcaggactatttgaaaacctttctcaacctaacatcatgtaatagcaaagatctaaaacttaccatgcttttggtcctttttctgtttgtcttacagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgtagaaaatactgtttctactcattcaaagcacattgtagatattcagagagaagaacaaatggctggcttggcaaatccccatctgagataaagtaaacaagtgaccagcagcccacagatgattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttaagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccatcatctcctttggctgctgtaacaaattaccaccaataatatgatggcttaacacaacagaaacttatttgcttacatttttgaagggcagcaaagccatgctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaattcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttatatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttacaatcattcagattgtgaattcaggctcagaatttacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcatgccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacagccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaatgttgtgctgcctatgataattaagattaaagacaagtgaaaaggcatgaactatcgggggggagaagcttcaaccaaacagaagtgcaggagtgcttttgtatgtgcctggtccagtggagatcatgggatcatattaaaaacatacttgtaggaatcataaggttttctttagcactgcttgccagagtagtggagatatggtacaactgaaaagtttagaaacatcagaagggtgatttacacgctccagagaaactgtttcaacagagaagtttttcgttttgttttgttttttgttctgttttggtattgagtatagaattaagcaagtgggcttcaaatgcttagaagggtaaaaatctggaatgagtaataaaaggactgtagattattattttctggagagccttcaatagaatagctcatcatgggtggggtgacttgaagatgaaggtctggacaacgtaataaccaggtctataaataatacaatcagaaacatttgtttccaaggcaaaccaaagaccattgtttcccttggaatggtttacatcaggaatcaaatacattggctttttctcccccatgagacccaaataggcaaattccttaataggaagtctgaaaacgttagtatccacaactaggagaatttgagcttaaggccaagagctcaaaggaaaaatggaaatccagaaattaatatacatgcaatgcatgtaacatgctatatagttttgatgatttataataaaaagaaagctatagccaaatatctcatttacagactgaatttatttagatgtccagagtcccagtggccacaaataaaatattattacagttagtgtccatttcagaaaaaacaacttgcaaatatatgaattatgcaaatcataactttgttcctagttcttggagatgagccagagttcaatctttagccatgatgaccttatatcttcgataatagcagttcagctaatattttcacctatatcttggctaattgaggttcagccatcaccttttgatgtttatgagcaaagtgtaaacactattatcctattatttgacataataataaataatataaaacccctcgacttctctactttgttaaagtctgcccccacccccactccccagtggggctgttctaatcattgagtgtccatttgatgcaagctgctttttcaggacacaattatgaattaaacatagctcctggcttcaagatctcacagcctagtgggagatgggatatgtacaaacagaattgtaatccaaggtggaaagaaactgattgatgttgaaaccgatataaggcctgtggaggttcagaaaaagcaagaatttagttttagagaggtggggtggttattgggtgggaagctggtatctgtgtagattttgtggagtggctggcatttaaactgaaatttaagaggtaagtagatttggatctgtgacactgtcattcagtcagtatttactgagcacctattgtgtgccacacacaatgctaggctctgagactatgacagtgaaccagctagacgtggttcaagattcatggaactgacatctttttgaagagggagggagggaaggcatgagccgaggtataaacttggaaccttggtgcatatgcagagaatattgaacaattctgtttcactagagtgcaaggtccatgaaacacagcagtggatgtgtggtttgggcttcttgattcagtacaggatagggaaatattgaggagttttgagcaaagaaattatttggagcactgaaggaagatgactctagaagctctatgtaggaaaggtagagtggggagaggccacagaaggccaactttgttggaggttactgcagtaatacttatgagaaatgaggccccaaactggggtagcagttgtcagtggcaccacagatacgcacagctgcagctctgaggcttgctatgatccttttttttttttttttttgagatggagtctcgctctgtcgccaggctggagtgcagttgcacgatctcggcccactgcaacctccacctcccgggttcaagcaattctcctgtctcagcctcctgaatagctgggactacaggcgcatgccgccacacctggctaattattattattttgtttttgtattttagtagagatggagtttcaccatgttgcccaggctggtctcgaactcctgagctcaggcaatctgcccacctcggcctcccaaagtgctaggattacaggcgtgagccacggtgcccggccgctatgatcctattatctgtactgttgaatggctcatgcaagccttataagcaagtagcatcaaatcatagagacatgaagcagacaggagaacatgatttctgcacaacttattcagtaatattatagtgattatggtaataagagcaagggtaagatctctaggttgctttcttttcctttcctttccttccccaccccctttcagttcccttcccttttcttcccttttcttttcttttcctttctcttcctttttttaaaacaacactgaaagccaaaacattgtatggctgttcaaagaaagaaaaaactgacaaaagactgagtgcacattaaaatatactgattcagctttggtttcataccgtcaggaaagaaagatatttagataaagtataatttatggggaaagcttcaattagttcatagctaggccttcttaagtgtctggttaatattttaagctgtacatttaagaggttcttgaacaattattattttctaaaagaacagcagattctctgttttactatggtcccagtaatctcttagactttcaaactgtgcccaagtctattccctttatgctaaatgtctttctactcaaataactctaagacttccctcctaggacattcagatgccgggtcatgtgacactgaatggctttattttggctaatattgtgttattccagaatgaggcctgttttatgaatctgctctatctccttccaccccaaataccttgtgttgccatccctccattttcctacaaaaactcaaatatcacaatgggaattaaattgaaaatacctaagtactatgaattttctttttgaacaagtctcggaaacctatggcatataatagcacagtggcctcgacttttggacaaaaatcgagtaatggagtgctttatctggctgaacaactggtagcacttaatggtggtgcttgagggaaagagggaggggaaatgaaaggggtcatgtactaaggcccctagcagaattcagtataacgataaaaataaaaacgtcttccagatgtcaatgacttttttacttcagagcatctgtgataacaaagctgacttgctatgaccttacatcttgtagtactttgtattattgtaaggacttcacttttaacatccattatccatcatcacatttcctctcagtctacaaacaaacatctttaaggttccaccatactattaaacaacaaccttcaagctgtgactcttcttcaaggctaccaatgacccacctaactgccaaatcctacgaatgcttctgaatcctcatcccacttattttctctcatgtcttccaccaagtgtacctagccctgtcttcccctacctctcagaaaactcattcccctttatcagtggttgtcttcaaatgacccctaaatataggcattcttttattttatttcactaggttttgggagagcaggtgatgtttggttacatgggtaagttctttagtggtgatttctgagattttggtgcacgcatcacccgagcattgtacactgtacccaatttgtagtcctttattcctcaccctccccccacccttcgccccaaatcttcaaagtctattatatcattcttatgaataggcattattgttagttgccttcatttgtgttctcttcaccttccagggtcatcttagccatatccacagcttcaagaatttctttcatggagatgactctgagatctctcctggaccccaaaaccaccttcccaccgaaaaggatagctcacacactaaactccgtatattcccaaccaaatatgttcttctccagcaaacttatttttccatccaggtcagtcacctgtctcagtattggcattagccttttcccaatttctatagctagaaactctggaagcattttgtattattccctctcccctaatatccagccaggcacagaagttgccctccctgtttcagtctcttacctcttcaacccattcttcacactctagagagagcatcctaaaatgcctttcttggcccacttcaaaaatctttgattgttctccctaattaatgaaaccagtgcagccttcaaaggtctcaggagcagacccaagcataactttgacgcctcttctacctcattccttaagccatgccacacaggagttatcattggaaaatgccaatactaaacatatgattaagtcactgactgtgtatataccttcatgccattatacacacatgcactttgctctgactgttatggcctcactgcccagcctcaccctttttctcctatcaatccttcaaggaccaatgctgcctttctgaagcctttcttaatttttcttcccccactaaaataaattgtgttatctatgctcccacagcaatttgttcatacctctattctggcctttgtttcattctgccttctactacagttgtctgtgtccttgactaaagtgtaagttccttgatggcagtgacggtctcattcatctctgggcctttacacaaagcaattgctcaatgaattaatgtgtagtgtcaactctcagggaattaaacaaatgaaaaggaatgtttgctacaggtaatggaaaatcatagctaatttcctcatccaggtgagaacatagccttcatcactgtcctgggaactgaggacctgcctaaggtcagcattaaggacaaactccccgaactgtgtttagctggaagttgactttagaggagtactttcaggaggtgaggaaggattgaagacaagtaggaagtttttttcctccaaggtcaagcttttaacaagtgcctgcaatgtacactgagggatttggctgtactccaattatgctaatatgttttatatatgggcctccagcatccaggaaccacctccctcaacaatttaataagtgtaaatatcaaggcagagttgtaaatgtggaacttatttgtaatgtaccaaccttgttattatcaaatgtcacagggtataagtcatggcaattatgctgcctgctttttattacatttattttactttttaaaagtgcagtatatcctcataagcttctcctattctgccctacccaaggaacctagtgtgcctgtgtgttctggagtcacagaaggcagaaaatttagagtcacaggattaatgggcatccctagtaagaaagcgacctcgtgaatcattgactccacgcactgacaccatacctctacattaggcttcactgtgtatttcaacaattcaagttgtgagaccttgtgagtttctccatacaagagatttcatgatttaaagcacagaattgttccttcctccagcttcctaccatctgagtgtgcagatgtgtgtgtgtggtcctgtcatgggaaagttggtcattttgcacaaagccttcaaactcgatcggccagcttggtgtgatacagttcagagtcacctcttcagtgttctgttggcaggtgaaagtgaggggaagtgggcctgatttttctggttaggaccagaaaggtatccactatatccagcacataattcccatttcccagtagtctctttctcctcccacttcttactaaattgcatcaatcactcagaagcggaagggtgggtgaatctcttcctccatataactaagcattctgtggcaacagtccttttttcttatagaggagtcctaacctatctgcaggctttagcaggcttccctggtatcaggcagaaaacctgccaagccatagaaatctgttggcaagtagatctgtttttaaggggtttgaaaagtgccactgctttcgaagtttcctcgaaagagaaggaccaaaaagaaaaaagtaatacttcatccttgcacctaggaggtactttagtagtcatatttcccctaaatcaaagcaccctcctttgtttttggtttatgatccaacaacctcataaacaagctattcatctcttcatcattcatcccacaaatattcattgaacatctactgcatgacaggcactatgctaggcactacataccagcaaaagtagacgtgttttaggtcttcatgagcttagtcaagtggagcatgccaatggcaaacaaatcaatatgtgattacagttgtgtttagtgccttagaaggaaagactgcagatattgtaggagaaaataatggtgtgagagagagtgtgtgtgtgagtgtgtgtgtgagtgtgtgtgtgtgtgtgtgagtgtgtgtgtgtgtgtgtgtgtggtggaaagggaaggggcctaagttagattgggtggtcatgaaagtcctctctgaagaagtgatatttaattagagacctaaaggatgagtaggagtcagccagattaaaagtgcgtaattgtgtagtcaatgcaaaaaggaagtaaagtccatatcatgggatagtgtatttgtcagcttttgctacgttgtatgatggttaaaaacaacccccaaacctcaattagcaaaggtatgctgtggcagccacaggtcatctgtggcactgcttcattgtgtcttcttcattctaggatcctggctgaaggagaagcccttttttttggacacgccaatcttacggcagagggaaaagagcaaacaatgctgaaccttgccacagctttcaatcttctgatcatatgtagtggaagtcactttggctcacattccattggcaaaagcaagttttatgaccaagttcatgtcaattcatcagggcacgtggcaggaggcaggaggaaaaaagaatctatagaaacaataacgcaatctgccacagcccttgtctgagttccacctatacctcttactaatagacgttacaaacatttcactaacttctcagggcctcagtttcctcacctctacaaataatgtttaaaacaactgaagagaacctaagatggtttttcaagggttagagctagcccttaatttaggaagcaacttgggggaactgaaaatatataatctggaatctaagatttctctacatttacccgcagcattttctttcaattacaatgatacaaggaaggcgagttttagcacgctaccttggccactaactagctatgtgatcttgggcaacttactaaaaccctgtgagccttggactattgtaaggattgtgtaaagtaatatataggatgagtacattttgtgtattataatggcataaacatactaatcattattataattatctgactgccatgatcacctctactaagatccaaaaatctgcctctcggccagccacggtggctcacacctgtaatcccagcactttgggaggctgaggtgggtggatcacctgaggtcaggagtttgagaccagcctggccaacatggcaaatctctgtctctactaaaaatacaaacgttagcccggcgtggtggtgggcgcctgtaatcccagctacttggaaggctgaggcaggagaatcacttgaacccaggaggcggaggttgcagtgaggcaagatcttgccactgcactccagcctgggcaacagagcaagactcagtctcaaaaataaaataaaataaaataaaataaaatgaaataaaataaaataagatattaataaataaataaatctgtctctcatactctcaatcccacgtttcacccagccacctcaagctcaccatgtcaaaaatcaaacttcttttccctctcaggcagtccccattcagttccctctccagacttcctgatgttgatcactggcactgatgtgcttctaatcaccaaggtcagaaaacttcaagttatctcttgacagccacacccctactcagttctatcacttctccttccacagtatagtttacatttctctctttctgatttcaaagctaccacctaagcccagaacctagcacctcactccttgattactacactaactactcttactccctttacttcaccccaggccaaagcagccttttgattatctgattcccgtgctcaaaatcctgcagtggctcaccagtaaataaaaaaataaagtccaaactcttcagctgagtggccgacatccttcagaatttggcctggcccactttttccaacctttcttctcactcttacccatatacaccttctgctgcagcagtactgacctaactcaccattctctgaaaatctccaggatctagaatagcaccgtccgggagaaatctaatgcaagccatgacatgattttaaattatgtagcagctgcattttttaaaatgagaaacaagtgaaattcattttaatgtttctattttccaaatatcattttaacatgtaataaatctaaaaattaataatgaaaaattttacatttgttcatactatgtcttcaaaaatccataagcattttacacttgcagcgcgtctcaatttgcacacactagccacatgtccagtgctccatagctgcacgtggctggggctacagtactggacggcagagatctatcccccaccttgtggctcaaggcaagctcccactcgaattagcacctgtggaaatgctgcctttcaaagacccagcttcatagcctccaagaagtcttcccagattctctcaactgaaagtcatctttcccatttccatgctataccatacacattattttagtatattaatacattttcaaatgttttgagtagataacacattcatttgtctcaaactcagagagggtaccgaaggatatgcatacaacattcccagcccgtcccccttcctagccaaactaattcctttccttagaggccaccaatgtcatttgatttttgtatgattttgcagataaatcttacatacatatacacatgtatgtaaacacacatttcttccatctctttttcaacaaatggcggcaaagtaaacgtgctgttctgtaccttacattttttgcatttactagtttaccgtagtgaccattccacatggaacgtacagtacatgaaatgtttcattgaactttccactgcgcattaaagatcattgtatttgtgtctgtctccctgacaagccttttaatttttgaagggtatacattttgtcttcttttccgtatcctcgcaaagctctgcatcctggactctggtgctatacacaatactcaataaatatttattaaattgctcaatcagaatgatcttcttaaaatgctcttttgcatttgacactctcacccccaggaaaataacattaacttctaattgcccacagcatactttctttctttcttactttcttttttttttttttttttttttgagacagagtctcactctgtcacccaggctggagtgcagtggcgccagcccagctcactgcaacctccgcctcctcggttcaagcaattctccttgcctcagcctcccgagtagctagaattacaggtatgcgccaccacgcccggctaatttttttgtatttttagtagagacagggttttgctatgttgaccaggctggtctcaaactcctgacaccttcacagtcaggcccaactttcctttctagactaatctttactccccagaaacacactctttgttttaaacaagtctcctcactggaactttcccacagttggtatgtatggacctatctacttctctctctgtgtgtatattttattctaatgtcttcccaactagactataatcccctgaaagagaggcaatgtctaatgcctttattcatcccaggacagtacctacaactccgtgattctcattgcatgcttgatgggctcgtaaatatctttctctaggatttcttccctcctttcctttcccttgggcctggcctgccccaggctggatgataattaccccgattgtacatttccttttggcagagacagaatacagtttgtttctctagttcatttttatttttaaatcattctttcctcattcaaatgattctccagccagagaagttataggcagaggcagtgacaaaggtcaaagcacataataagtgtactttctgagagggagttttttttccccattttaacatttttgtcttgaatttcaattacttaaatccaaaatcactgccttttcctatgtctcaaataatggaagctgctttgagattcacatcaaaagccaacatggcactataatggctctccagcgcttgaataaagcccagtagtacttataacagtatcagctcaaaaatgggaagcgttacaatagctaccacttaatgagcactatgtggatgatactattcgaaagctttacacccttcattttatttaatccccacaatcatcctgagataaactctattattcatattttacagatgactcaactaaggctcagggaggtaaggtagcatgatcaaagtgtctatcagaaagtgatagagatggaacttgaacccaggcaatatggctccagaacacatactccaacccctaggcatattttctcccttagcttgtgagagccaatgcctttccggtgtatattgcttgaaatctattatatttgaacccctcaggagcacaggtgtcatcagcctcgtctctgcgtccctattgtttcctcttcccttcacttggttcaaaaagaactgttctgcttttccactaagcctcttcaccatttgactgctactatctggggaagcctctctatctgcactctgtatctagagtgttccttgctgctcgaaatatactccacggtccagcagcatcagcatcaccagggaacttgttagaaatgaagcatctcaggtatcaccccagactactgaatcagaatctgcattttaacagactctcaggtgattcgtgtgcacattgaagctcgagagcagcgctctccatcttttgcagtacttactcccttagtaattccttgctggagtgttccgtacacagaagtctaaaatctatggcttgaaagggagggaatcatttaagctgttccctgttctctggcctttaggagctccaaaatcagtcagagaccatgctaagagtagatcttgctgtcattagactaacaaatatgtggacgaaatgaaaagacagccacgttagccatgatttcctttccatatttcattcatgctctccctgtatctcacactgccacaacacagatgctttcttttatatcatgggaacatttttaattaaagcattggaacctttgagaatagacaatcctttaaaagttaagtttatctgtatttacaagcctccatttatttggcagtgacaataggaaaaaaaaactgctgctaaaggcatatagaggaatgattaagctaatttacaataattgctttaatcttgacatattgaattgtagtgtctaactctttgagttctctcggtctgaggtaaaggaaaaatataacactgtgttcgatattgtacctctgaagcacaatggaaattttgccctacagtgccagcctgtcacccatggtgtccatgtgatagaaggggagagatcacccgcaatgtctaattgccactgtactcactcctgtgctttaagatagaaagcccatgttcagaagcaaagccattagcagctattaattgcttagctctaataaattgtccagaccaggacttaattagggaagacatttaggaacaggacacaggacaagaggacataaaggagagccaggaatgagatgaaacctgagcagccaggaaggccaggaaggggcccaggatggagagagggtagttgagatatccggatgtcaactttacttactttctgatcgcgtttcaagacagtccggctggttgcttcttctaaagactcctatagttttgcatctatacctctccaggaagcacctggagtaggaagagccgtggtatctaaggtgatatgaatggtttctttttgctcttggcagctctgctcacccctgcctcccctgaagctgtctacttctctgcttgatgggactggctgggtcaggcctggttttgctttctgactgactcaggtctgagtcactgatcaagaggaggaagtcctaatcatgggtgcagccctttcaagtaagaaacatggaatttcatcaaaagggactgtgagctctccgagacatttggctgacagttattgtcccattatttcacttttagagaaactacattcttcatctttggcccttcgtgaactctgctccaccagtgatttcaatctcaaagtttcctgaagggctttggccagatgtgaccaacagctcatcatgagctgatatctggtatacggcctcaaacaataggaagaagatgatcattgtattcatgcaacatttatataggtgtctctctccagattctggcaagaaattgcaaaaaaatgaactattgcttttgaattggaaacaaagtacttggctgctaaaaatgtggcactgcagcccacttacaacagttgagggcattacaacagttggactctcttggtgtcattcctttaaagaaaagcattatcagcaagaagcaaatatgggtcattcttattaatatttccatactctaacttccttctgaggggcttggtgcattctaactcaattatctcacttatctttgagggcttttgattatcttgggtggggttgtgggacagggagggtcgacacacaagcacatatcctttaagagctcacagatgcttttacatctagcaacttgtttgagcctcgtaagtctatgaggtctacagagatgatcataccttatttgtgaaagaaccatgtttgaaagccagggcttccagcactacatcccaaataccccgagagctgtggctctcagcaccactgttgctgtagacagcattcactgttctttaacttccaaggatgtcagggtagccgtgcgcttgcaaagagggggcaccagggcttttttcttcccctgcttcatttgctctttatttcttacactctgactccttattgaaggtttgtggccctaaatgcagtttctttagctgtctctttccctccaaccccaggtagtattttagcctggatagttcccataggtatttctttatacctaaattcaaaagtgtttcttgacttccttaaacctatgcccttttatgatcaacatcttgcatgtcctaccatttctccccctcccctgacccttgcaaagacactggaatggacattcatccccagtggagagttcaggctcctggtttccatagccttcatcttatccctaccagcagccacatttttacgaatctttatttcctgttttaagaaagcaatatgcctattttttctctgcgatataaggtagcataatattgataggatctttcaaactatttctctctggccctggttctgaaacatatagccccttgagaaacatggctctattattacctatcaagttttattatatttaaaactgtttccacatctgttcccctaaaccgtgacctccttgaggatggggatataatctggttaatctttgtatctgcaaatgccaagcagagtgccaggtacataaattgttgaacgaacgaacgaatgaatgaatgaatgaataaatagtgccagaagaagacaatgctactccatcatttcccccatgtcttgctctgtttttagccaaagtacaaactggaagtgtctaagatattttaacacccaactatgaatagtgtcaatgaaaatgacaatagttcccttctctgttcccccattctgtctattttcccatagaatctttactgctcaggttctatatgcttctgcttgactaattatacacttctttctttcttcttgaatgtttaaactgacagtaattgcccagaactgaatgcatgacctctaagaatctaatactactaaaaagggactggtttcacattctaatctggctgtcataatcatcctcaagaggattgattcagtaacttggaagaggttgccatgtcaaaataaaggttcagctcagctccactggtcagcctaccagctgcacctgaacttgaaaatacctttgtattgttagttgttcacatttctttttataatcaatagatccatgcatctggagtgaagaatcaagtattttgttttgttttacttcatttcaatttttaatctatctaagtttctgtaaaatataataaaaataaattactagataaatataatggaaaaaagtcatgcaaaataaaagctcccatcttttttagagtcaacagacaccagagtactctgttaaattgctgtaaggttcctgaatgcttactctcaacagctacgcttacctcatctcacccccctcaacccatgattctgggattacatcaatctgtaaagcaagaagtgaggagtgctgcatgagactgtgtgcttatctaggccttaaccaaaccttattaaggcctgaattgtccttgaatccccagagcctagcctccattatacctagtggttattgtgtccaagtgaatgccggtgcccttctttaaaggtctatccaccttgtgagtgtgagttagaattgatgtaaatgattcagcactgtaattaaaggtgcaatctctagagacagactcagttttaaacttctggtttagccacttaccagctataagaccttgagcaagttatttaacctctccgtgcttcagttttttttatttataaactggggataattatagtatctatcccatagtgatgttgtgaggaatacaagatgtgacgcatttaagatacttagcaaactgtctggcacatagtacaaactcagtaaggttggctattatctccacgtgactgccttaattcattcaggctgctataacacaataccataaactgggtgatttgtaaacaacagaaatttacttctcatagttctggaggatgggaggttcaagatcaaggtgctggcagatttggagtccaatgagggtccactttctaattcatagatggtgtttttctgttctcacatagtgaaaggggtatctcttttgtgaaggcactaatcccaatcataagggattccacttcatgaccccatcaccacccacaggctctgccccttaatactatcaccttgggggttaggatttcaacatgaatttcgggggcacataaaccttcagaccatagcaatgactaataaatggtgttaatgtccccttcatttcataagagagtgaaattccaagtttacagtcctacaggcccctcaacccatgactctgggattacagaaattgctctaaggcatgctgtcccttctcccttttttctactcagagtaatgtctcattctcattgctcccaacaaggctcctgcaccctggcaaatcagtttacttactattgttcccttatactcagctagctaattctcacttgttgacattttcccaggaccaccatcaacctggatcaccctcttctttcatctctgttatagtcattttccttgttcaaaatcaatctccaaaatagcctccataaacagtagttctcaaactttaatgttcatcgcgatcacctggggagactgttaagcatgccctttcctgagctccacctcaaattctgatttacgaggtctggggtgaagcccaggaatttaatttttaaaataaggcctccctctgtctacccctccaactgccaggggactctgaggcattaacttttttgggtcatagactgacaaaaaatgttttataagaaaacatgaattaacaccacttgaatcaattctttctctgaactttcttaaatgctaatacttttaataaagtaacaccatattaattcagcttcattaaattggaagtcttgatacttggacagaagctaggctgccaaaaagagaggtgggaggctgaggatgaatctcccttcaagatgataagtagagctagccatgcatatttagataggtgccaattaattctttgctgatttattcattgacaaaattctttgtttagtccactcaaggtctcatctactatttctctcacttggattattgccctagtctcttacccagttccccacttcctctgatgctgcccgatagtctattttccacattcaacagaaaacaattgaaaggttttattcaggtgagtgatacactagaattttattttttaaagatcacaccggtgtttatcgtaggataagggccaaaagcttgattaggatctacaaggccctgcatagtctactcccaactacctttccagcctcatcttgttttatatgccccctttctttcagttccacgattaggaacagttccttctgctgcagaacctgtgcataagctctttcatcaatttggaatgttcttctcagcatcccctcctaaccccgtgtacccactcagacacacacttagttaacccctacttatcttttgaatcttagctcaaatgtctcttccacagagatatctccctggcttcccactctaagtcagctttcattgctatatgttttcagagaatcatgttacttttcctcagaatacttgtatcggtttgtgattacacagtcattattattactgtaattattcaatcaatgcccatcttctcttgtagatggcaagctccctgaggacccaaagcatatctatttttgcttgtcactatatcctctgcatctagcataatgatcagcatacagcaagcccttaataaacgtatgttaagaaatgaacaggatgaatcccttctgttccttcccagagcagaccacaatgatctaaacttctctagtttcttcccaaagctaacactgtcttgactgtgtaggagtgtgtgtgtgtgacatgagttcaaactcccctagagggaaaaccccggtcaaggtaataggactcaaaacctacccacttaacctttaagcttttggccagctccatccgccaggggatgagacaagcctgatcctgatggctcctgcccattggcctttgcactgaatagttagcttgtttctagaagtcacccgggcatcatggtaaagatgggatccttgttcaagtcattaagttgcagttcagcattatcaaatcttgttagctatcaccttaactagcaaatgccttctatattaaacactgagtaattttactttgattaagttatccatcccactccttctgatatgcatgtaattatagttcttgaagtgaaatcgaggaggaatggtaacaagatattgctggtgacagtgatggggggatgaatgggttgctagtgtagtgtgatgtgtcatttcttagcccagatgccattcagaatttcacaagagtggtgccaccattttacataaaagccacatcaacaacctggaaagcttcagctaaaatcacatctgaggttcaagagttgaagtatattgactccttgtccctattgctcccagcataagtaaactccacataaatcctatgactccagatggatagaggcataacatactaatgtttctgtcaaaaaaaaaaaaaagccttaactacagagcaactggacaattcaaatgattttctaattggtcataattttccaaacattgtaatatcacatactgaccatataatccacctgagaaaaggcatgccgcaggaagaccataggcataactggcctcacaattactctgtctaaatattctgctaattggattttttttcaattgtgactattttaactgtcctttccaatgatgtaataagtgatattcttcaacacgtgagatgctgttggcaagctctgtggatctgagtaatttgagtagctttcagcaggttttgcaaagccattttattttatttatttatttatttatttatttatttatttatttattttgagacggagtcttgctctgtcgcccaggctggactgcagaggcgcgatctcggctcactgcaagctccgcctcccgggttcacgccattctcctgcctcagcctccccagcagctgggactacaggtgcccgccgccacgcccagctaattttttgtatttttagtagagacggggtttcaccgtgttagccaggatggtctcgatctcctgaccttatgatccgcccgcctcggcctcccaaagtgctgggattacaggtgtgagccaccacacccggcctaaagtccttttaatacaatgattttttcaaatgagtatgccttgtatgtatgtgttatgacttttcctttttagttttaacttgtaaatggaataaaattcaaacaaaagtagtgttaatatgaaagtataaaaagaaaatatccaaagtgccatacttttcagataatctcaacccatcctctgttaacttgtacatatgtccattagtctctgtgattaggaagcatattggaaaatttatttccttggtgatacccaggttttgttcaatatataattttaagtttctcaataagaccatctgttatgtaaaataatctcttcatttcctgaaaattcatttacaaaatgtttggaaagtgtccatttgatataattattccttgcctactctcttttcccaatctccattaaaatatgcatgaggatttttttttaaatgaggtaatcagtgagatcagatgacaagttactacagtacccagctcctttgccatggataactggactgtggatagacactagacccaaaggcagtatttataggctgaccagtggcctatggggtggagcggcataagaattctaaccaatcagatcctcactcaaagggattttcaatttgagactcaaaatatcagcccattggtcagtagtcatagaagtaaaagcagaaacagaatagctgagctaacctaatagcagagctccttgtgagaggacagcttactgttgtatgatgaacagtggtgaagttatttagatggcttgtgtagtttatttaaaataaactttgattgactgagatgtgctgagcatgtcactattctgtgtaacttgactgtgcctaacacatggatcaactttttaaaatgttctgaagtccagttgtcaatgtagagcaaatagaggctgaacaaagataagaaaccaggtctcttcattcctagtctaatgatatttacaagatcaactttactttctttcagaaaagctttagacctcaatgagatactgttatttcttcagacttgctgctatcaactgcatcaacactatgatgctatcttatgtataggaaagcctgatgacaatctgtgaaaggacaggcaaatttccaggtgatatatgtaaaatatttgattgacaaaaacgtcactgctaggaattaaagaaaagctacacgtagtcactcaaagctctggtgagggaaactcgcacccagaaccacacttaactcttcagttggaaaacaatttttgtcaaatgtttcagtagaagcctttaagtatgctttgtatgctcagatgtgattaaatgtacctcttctgagtaaatctgcctctacaccagatctgttcaaagtttggggacagtaccaccatttcccttacttcttgggatagtatcccccaagattcaactttctagcagttattatttcaaggccaggaaactttacctaaattaagctaagaaatataatgtctcatgctgatttttcaaaatttaaattctccatctctgaaagatttctttgtattatgaggtatctggactggtgaaacctaatttgtaagactttccaaatattggtaggttcagctgatctacagaatcaaagtggcttaaaagaaactttgactctatttctttgaacctccatggccacatctgtaaaatgagaatgataaaacttgccatgccaatataaccctcctgaattttagaacatgagagttggaaatgcctctcccaagtgatctcatccatcctccctgctttaccctgtggttaaggtatgagcatcaaatgagataacagagatgcgtttagaagaatgctacaaggtattaacatcatcactctttgtttttatttgagtgatgccattactaactgttccaaaggagcttcttggctctttatttattggttatcttgattgaaaagacctccagactagctaaagtcctggacattagctctatgcagaataacagccagtattttttttttctgtctgttctctctgtttctgtctccacctttgatagttacatctaaatttatccccagaaaaaccaacatatattcttaaccaagacagcacttcctaatttgtcctgttcaggtctcatcctccttgtagaaaaccagtatgtcttagctgaaaaagctttgagacataatcttgtctagagactccttaatgccagtctgcaaaccagctgcatctgaattacccaggggacttttgacaaatgtagacttttgtttgtagttttgttaaactcttattacaaaaaattcaaacaaacaaaaaatgacagcctgtcatgaagaactcttagatacttaccacccaacttacacaattaaccacccatgtttaatcttatttcatttatatttcatccaaatctcatgtataaatatttcaaaatgcaaacatatatatttcatttttgttttttcaaataaaagttcctggaattctgatttggtagttttggtatagggcccgggaatctgtatttgtaatagatgaatctgatatgcaattttcagaacagttgtgtttgattctccttctcatacatagagaaatagaagctaaacaaggacgtcattagctgaagtttactccattgctttatcccaaagacgggttactgttttgaaaggagaaatattctaaagaccattcagaagaaacaaaaacaaaaacaaaaacaaaacaaagcaaaaaaacattatttgagtggtaagtgctttgaaaataacaggctaataccaggaggcaaggaagcaactttctgagatgtcaactaagcaatgaagccttcgcagtccacactgaagtctcatgcctttgagctcagccttcattgactggactactcatttggaagttaatcacaggcagccttgtgacagctcatgtattatggaatcgatttcactctttttttttttttgagacggagtctcgctcagtcgcccaggctggactgcagtggcacgatgtcggctcactgtaagctccgcctcccgggttcacgccactctcttgcctcagcctcccgagtagctgggactacaggcgcccaccaccacgcccggctaattttttgtatttttagtagaaacggggtttcatcatgttagccaggatggtctcgatcttctgacctcgtgatccccccgcctcggcctccgaaagtggtgggattacaggcgtgagccaccgcgcccagccagatttcactcttaaattgccttaactctccaaccaaattgtaagcctatgaagggtagggaccttgcctgattcagctttgtaccactcttctccccacctcctaacaaaaccccgtttggtgtcctgtcacatgtgatattttattgcagtgcattacttcttactttatatcactaggagattacttcaccacatttctatgctgatgtgctaaatgtagagaaaaagtgagtgtgtgtcataatgtacctaaatacaaggactatgtattgtgatctatgtgtcgtgattcaaaaggttctgttggaatgtcctgaaccaaattcatttcttcagtggctcaccatattgcctggaattgctaccctttatcatctctttaagtgactggattgaaaccctaaagttcacacaggagttaatccagaagctccttagcataaattagctgacagagctgattgcatttatgatgcaggtctctttgatgtcataaagggatcataggcttcaggtcgatagctcaattaggattctccagtggaagttaaggggctcttgggtaccccatgggtggaactacgtttgctgaaaaggggcacagtggttgagaatgcaggttttggagtgagatggatttaaatctcagtcctgagtctaccactgactagttagttatgtgacattggagtagtcacttaacttctctgaccctcatttcgttcatcggtaaaacagagggttaacaatagaactcaatttcatttattcaacaaatttgagggccatctatttgctaggcactgtgctagggactggggataccagataacaaggccaggtaaggtctctgcagtcctgaactttaattctacatttaaaattttgctgaggctaacatgagataatgcccgtgaagaacttagcgtggtggttggatttgggaaacacgacaaacatcacttatcttcatggttattattatccaggaaagaaggtgaatggcaccacgggaaaatatttcacaatttgcccaagactcatgctggtaaagaaaaaatttggctcagatcccccaagcctatgaggaggctagaagcaacccacaaaaggacatttgaggaatggagaaaaatctctctcaaccaagaagatattcttatttctgcttaaaaccacagcataccaaaagaagcgctcttaccacagcagccaatgccatgttggggtctacttaagccagaatgtttttatcacgtgggtttgcgtgatagccagagcaacagaggtattgataagatttggctgtgttgcctacaaaatctcaccttgaattgtagctcccataatccccacatgtcatgggagggacctggtgggaggtaattgaatcatggggggcaggttttttccatgctgttctcatgatagtgaataagtctcatgagatctgatggttttataaagggcagtttccctgcacacgctctcttgcctgctgccatgtcagatgtgcctttgctcctccttcgcctttggccataattgtgaggcctccccagccgtgtggaactgtgggtccattaaaactctgtttctttataaaatacccagtttcagatatttcttcataccagtatgagaatggactaatacaggtatggtgagtgagctttttgtagttgaggcaaacaccctgtgtactttaatgtttgcacaatcacagtcagagagggtgcaaattctctgtgatgagcatcaacaggcctgatattaggaaatgatcattgatctggtgagaactagtatgaagttcaatacacagaaaatgaagaatagctacaagacaatgaagagataaatgataatgcaagaggagggtacagggcttacctctgaagacatgacttgaaactccaatgtaaaatatccagggaggcaggctgaccttgagcttggttcagaagggaattgagaggggagagatgtaatctggaaggtagggtagggaagcagcacccagatctccaagggtcatgcccagcacgcaagataatgggtctagtctaggaaacaacaataactttagtccccatctactaatatggttgaaacttccaatatattttctgccctggtcaggactagcttaatcacttggcagggctgagcctgtagacaccttacattagtgactccagctgaacaggcctgacatcaggtgtctttgttttatttgtaccataatagaaaaggagagataaaactcacaagctacagggttaagcttagcaggtgtgtacagaaacatctgaacacacacagcaggattctcacttaaagatccagacccagatatacagactcatattcagatccacatttgagagtcaatattcaatcatttttcaagtgactgcttattcctaccttaccttaatttatgcagaaagctaatacttatgcattgtatatattcacggcttaaaataaagggccgttgaataaatctaaagatgagttttgaacaggtcttttgcctgtgttctctttttcttcccgcaactgactaatgctagattccaaaggtcacttgtctttagcaattactctgaagcactacatcctacctgcagccttttaaacattctagcctaaagaggattcattctattttcttggaaataaatgtgaactgtcaatcgaatgccactaataaacgtttctaattgatgtttgaagagggggatttttttcccttaggcaggctgccttttatcttagtcagtggccttgttgtttataaaaaaattatttgtgcattcataaagcataggatgagagttaaaggacaatacttcccttttctgtttgtcaaattggataaaggcaccattagtactgaagggtttttcttttctcatgatttaaggccagtatgttttaacagccaaatcaaacacagattcagatatcagtttcactttcatgaaatgaaaatatctacccccatcaaatgcctgaggccaaatcatgtgttgccaagtttgaattttgctccctccattccctacttcagtgccccatcattttttttttaattgtaatatggggattacagtagctacctcatagaggtcctgtgaaaattagggtaaataagataaccattgtggttgttggagggagaaataatatctgatttcaaagctaactgagaaataagatacaggcttaaggcaaatgaagatgaaaatagccttattactgataacactgaactcaatggtataactttgatatgcagccaaatggttttagttattttctcctcttctcctctagtctttaagatgattcctctgaaggaatttgggtctacagagcagacgaacttacccataatgtcctcttagctctatctaattgcaaaccatggaccaatgggccggttcagataattcacttctcctcccatgggtaggattgccagatttaagatataaaaatacagaatacacagttaaatttgaatttcagataaacaataaataatttttagtgtaagtatgccccaggtagtgtgtagggtatacttttactatcaacattatctattatttatctgaaattcaagtttaatggagcatccagtattttatctgacaaccctacgcatgggatgaaagtgagtaaggttgggaagagaatttcagagtgttaccatggcagaaggaatgttactcatgagaccatgggaatggaaggtcctcctaacaaccacacagtgtgggagcacagtgtccagcacaaacggcgtgctaaacacttatttattgctttccttcatgcctataagaacccttgtagtaaacgaactcatttattccgaggcattcgattcttactatgatgctcttctaaaagtatttttactttaaatgaggtccaggaggagatcaatgcttaactcacagaaattcttctctaatgattgattttcagccttgaccgagcatcataatgccctggggagcttgttagaaatacaaacacccagaattcccctccccaagtttgattccggggtaggatctaggcatttgtatttctaacaagcttccccagggattctgacactcagcgaagtttaaagcacatcattctgacacataagtgcagtgtctgcaatgtcaaggagcaggggattggtgtattcagggaaaggtgtatgcttctacccaacaagttagctgagaaactattatgccagtgcagagaccattggtttagacccaacgttcaagatcatggacaaagagaagcatgccttccttccaatcctagtagcaataggccaaagctccaacaataaatttatgagcattgaagcacctgagtaaagctcattttaattagaggttccttcctgtgctcttcagctgccttagacattatgtgtgactggctctgagagcagacatggtcaactataccatctcttctcactgcagattacagtcccatgtgaaagggctacaagagaggcaagtacagggagtagagggtcaggaaggagtagggagggagtgtcaaggaaagctttaagggacagtgagtattgtccttcagtcctttaaaggtgggtagaaattcagcaaggggaaagagcaaaaagaaagatacatagaggatagcagacaagagactactagagccagagaaaaactgagacaaacagttatatattctaaagctaagagaaaccttcataatgaggcaaaaataggcagacataaggcggagaaagaagagaaagaaaaaagaggagaagataaacacacacacattacacatacaaacactgttgcattcacaaagaaagatcctcgggagatggagaaaacagaaaagggacagagagagatacaaatccagattataaaaataattgcgatcacccttgctgtaggattttcactgttgtttaaacatgatgaaacaaaacatccgatatacatatactttctcagaagactatctcatgctgaatgtataggaaatgaacaccacatttgctcattcttgatgacatttgctgcttacaaatggctgttttcaggggaaatattgattatagttctaaaagtaggtggatacatcattaatatatttaataattaagagtagaatcataatacagtattgagaagtaaggcagcctttttcctgaacttgatctaaaagtagactttctaatagctgccattgcaattctccagtactgcagtgtgtctccccccgcccccccaatttttattattcggattcattttgttgttgctatgaaacttttggaaaggccctttgcagctgatgagcccaaccgttaagtgtaggtgatttggcttctctgggcgatgttgttgagcacaccagcttcctggaagaaacacagtagagggagatcaattttgcttcacggtgcttaatatcacctcaaggtcttttcccttctgtttctttttcctttttttttctttctttttggagtcatacgttcaaataaccacatgtttgaacattcaaaggaacatggctcagcatgtctttgtaaaggtacagaaggcaatatggcattacacacgctcaatatgctgttttgaattctctagaactttgttgctccaaaatcaaatatcttcagataaagggagagtatgttgctcagtcagaaacatgtaggtgccaggtttgatttctcttctgtatctttagcattttcagcatctactttgtaacctgaagggttttttttctctccctctctctcttttccatttgtagtttagaaaataagcaccagatgaggaatcactgtatctggggaagggtaccaggtgatttctctttgaaaagcttgtattagccatggacatgaacctaggatgcgactggactgggtgatctctggtatgtacatgagagctcaatggacaaaagaggataggcaagcaaggagggactgcccatcttcttcactcctttgacttgggggaagtggtcactgtatctgtggatgcgaaaatggaattaagaatgccctaacaagaatcataactacaagaatctcccactgtttccctgtcacaaaaacacattattcatttcagaggaatgcaagcagttccaaaaattaacagcccttttccaaatgctcccagtggcttacagtttctgctgcaattgcattagcatttgcaattcttgtttttgatgacgactgagctcatgattggtttctctgccactgctacagctggtgtctttgccctggcacaggggcactcactggtgcccttattcccttgcttatgatctacttctcctacttatattcttgttctgctgctcttgattctggatgagagtttttctaccatgtggtcagagcatttttcaatgtccttaggtagcccaaaatatcaattatgacaattctttttatccccaatccaaagtacacttattccttcaggttgatgattctctaaatattagatcagcttcctctagagagggccgtgaagtacttgagtaacttttggcatttctcattgactgttaaccattctgccacgataaggaatataccagtacttctctaccttccttcccataacacatcctttattaacaaatcaatcactcaccaaatgtttactgagcactgtgctaagtactggagataaagtagtgaatgagacatagaaggctcctaccctcacagagattacagtttagcagaacaagaagcaagtaattacataaaagtgtaataagtcttatgcaaatgaaagcagatttgcagttgaatccaacagtctttctgaggaagtaacactaaatacgaaatatgaacgcatttgccaggaggaaaagaagtggggtaggagtggagattgttcccggaagcatatatagaagtctaagggaaagagagaacctagcaattttgcaaagctaaaacaacaaaacaaaacaaaacaaaaacttaaacatagctggaatacagagtacaaaggggagtgtggtgcaagagagataggataggttaaaaaaaagtctagacgatggagaactttgtaatcgagtctagaaactttagactttatcatgggtagcaggaagccacgtgcaggatataaacaagggagtgacttgatcaggattgcacttgggaaagcccagtctgactgtagtgtagcagaaccaactggaaaaggataaggaggggagaaagaaaaccaattaagagtttgttcttgtagtaggccaggctacaagtcgtggtggcccaagctagggtagtagcatggagatagagcaaactgggcagatttaagaggtagaatttactcaatttagaggtgggaggatagggaaaagaaataatcaagagggtacctggtttctggcttgtgtaacttactggcaggggcggtggtgatgtcacctattaggataggaaatacaaaacaagtagcaggtttgaggatgaagatgatttcagtattggagtttggagtctgagatatcattaagacatccaagtggagatgccaattagtcagatacagaggatcgaagcacaagagagatcagagatgaagctagactttttgtgggcatgtgagtctatgagctagttcaaaaggagcatgcagagttaaaaagcataagacctaggatatggcttttagtatcacctgcctttaaggactggacagaagcagagaggcttgcaagaagtctgggaaggagtggtcaggtaagtagaagtaaagctattaatagtagagggcagcgtaacagaaaccaacagaacagagaatttcaaggaggaacatcaaatgtcaagtgctaatgggtggtcaaacaagacagaacaagactcaaaagagtgctttggcttttattatacacaggctactggctaccatgtttaggacagcctcagctgagctgtcttagtggggtagcgggtgggagacgtagaggttggaagcaaaaacaaaatgcagtagttgaggagcagcagggagataggcaaatggagacagtgaatctagaccagaccctcttttggggaatttggctgagagatgaggagaaaaatagaacggtatcaagggcaatagactgcagggaaaggttttgttgttgctactactgagtggctggctctgtagtagaagtgaatattttgatatctactcattgacgatgacatggaatttatcttgactgcaaattccttctcttgggggaatgaatcctagggtaatacaggaagaaaagagacttgagcatgttttaaaacacaagagtctttgtcctgaatttcccagaagcaagtcagtcctgaaacgctttcctcatctctcccatgggaccacaggaacctcatgcatacagcagttttggtgatattccttgccacctcagagtccctgtggtgagtaaataaatgagactccccccaccccaaccaccaccaccaccaccacacacacacacacacacacacacacacacacgcacacacgcacacacaccaaacaggatgctgcattatttattaaaaaatattctagcaatcttctttctccttctgggaggataaatcatttaaaagcattatttctgttgctagttgttcaagttttccatgaagatgaaaacacacgtttactcctatttctgtatgacctgaggtttcacgcttccaggagagggaattcatggtcaacatacattccaggtcatagttgaggattagaaataaagtatctatttcctttccagagccctgtggaggttcactttccctgttaaaaccccaattagaaaactatttttgagttaggaaaatgcaaacgtgtttctcatcagcatattatctctcctctgatctctatgtcaattttaagacattttttcttcatctatctgctaacttggcatagcaattagccctcaataaagatttgaaatgtgttaaatttcaggctttctgagatttagtttaatataatcaattgaaaataactaccttcttagtgtcaaccttttctatatactcaaattgctaacccactttgacatagaaacttgaatattaaaaaagaagatacacgctgggtgcggtggttcacacctgtaatcccaacactgtgggaggctgaggtgagcatattacctgaggtcagtcgttagagaccagcctggccaacagggcaaaaaccctcctctactaaaagtacaaaaattagccgggcatggtggtgcatgcctgtaatcccaactactcgggaggctgaggcaggaaaatcacttgaacctggaaggcaggggttccggtgagccaggatcgtgccattgcactccagcctgggtgacagagcaagactccatctcaaaaaaaaaaaaaaaaaaaatcttttcccatttcactcccagcgtgagtgtttatcctcttaagtttaccccctaaggaagttttcactgtcttgctcctccctctttgttaggatgtgagataatatgtttcttctctggctttttcaaaggctccaagcacctcacagaagagagaggaggggaggggagggagagagagattgatggcactcaaggacagcactgtcttttgtttggcagtctcaaaatgaattttccatcatcctctcagtgttttctattcaccacatttaccatgcacactccaactccactctccccaaactccagggctgaattagagcatacaacagacagaagcagtggctacccaggtcactgcataagcaggctattgaattgactcatgattagctggaagtgcctcgtgcctgcctcctaccctgatctggacattgcgtttctgtgcccagacacactgggcaggccctgtaggcttgtgcctgggccctgaccctcttccttggaacagccttgcctcttcaaaagaaattcctttttgagctactttatccatcataagattaacatgacacctccatacgatctatcacagatgctgacgcacttgcttccaagtataaattaggtgttgggcagtgcagaatgcagagctgtggctaagagaccccatctgcagctcacaaggcatggttgatattggctccggtagtaaaaaccacttttctggatggctagtaaattgccaccataggagatgataatatttgggaaccttactaacaagcttgaattctaacataaggcagttcattgttatgctgcagaatgtgaaatcttaatgcttttgctattcaaactcattttacaacatgatttactgcagctcgaaggatgcagcagaagggaaaaaaacagggaggtaggaggaaagagatagttgggagtggaaacatggatgagtccagctttgtgagcaaatttcattgccactgataatgtaatattttgctttgattaatgttctttctttttgagtgtatgctgcgtcccaataactgtttcttcagcccagtcactgattttttttttttttcctggattctgcttccaaaccaggcattgtggtgtgtgcaaacctagggagaaaagaaggaggaaacaatcccttgagaggtatgcttctgtccaaagacatgctgaatatatttgccttgccagattcattttctcctgccagaaattttcaaacagatggtggaggaattggtgtttgaccaaacagttgggcaatcaacaatagaaactaattgtcatagaattctgctaatggtacctatgctgatacttgctgacaaaacgtaagttttttggtactagtatcagggattctcttcaggaaaaataagttaaaagagctaagtagtcaagaccagcctggccaacatggtgaaaccccgtctctactaaaaaaatacaaaaattagccgggtgtggtggcgcatgcctgtaatcccagctactcgggagggtgaggcaggagaatcgcttgaacccggaggaaaagaaaaaaaaagagctaattaggcaaatgtttctaggaaatactgactcacttcaggaggacattattttaaatacagtccagtgtgggtacagatagttcaccctgtaccaggggactggcatgactgttgatagcgtctatgtgaaataaaaactggccttaaacagttattttgtggtcattacactgagatcatttttacctctaaagtcctgggtccctgggataactctgaatgaccaaacaaacaaaaaaaaaccccaaggtgtcaaaataggaatttttcaagttaaataatgtgctgagaactactgtcttccttaacattgattgtcagaattttcgatttagcctgcagtcaagtttagtgggtgtgtccctccacttatattccaagtgcctattttcttgtgagtatgcatttgaattgagctcagggagtcaaaaaaaaaaaaaaaaaaaagaaagaaagaaaggcaaaaacaaaagcaaacaaacttctggtagggttggtggcatttccagaagcttccacaatatggtcatgagatgaatctcggttaactctgaagacaaagaaaaacttcatttgagactattgtttttcagataaataaaaggcaaggttgctgggtgctgcccttatagagttttttatttaaaccttcacttggtttataaaataaagtccatctgtacactgaggtagcaggaagagggcaaaaggagacccgtgtttcttgagaggggtaaatacatagaaaatcacgttttccctgctgcctccttgtgaagaaaaacagctttgaatgtatcagcctgtgcatctggactctcctgaaagattaactagaaagccgcccttcccatttcacttttgtgtctctagatgtgacaaagaaaactcacttatgccttatttgtcacctcagacagttgacagacactttgccaatgtcagattatttcagtatctcactacttgtgcaaactggatcaaggaggcatttcagaaggcagcaaaagagaggcctctaatctttgcctgagtccattctacagctgaatggttcatctacctaacaacctacattgtctgtatgtaactttaccccttacattaagatgtgaacgttcatgcagcactgcactataatttgatttccatagatagttagaaataggtaaaccctttgtaccgactggtaagtattcattatgtgctttatcagagttataatactgtgtaacacaatttaaaacaaaacgaagtatatgcacaatgagaaaagaaatatccaaaacaaatgttactgtttttggtgcaaacattatatacaggttatttttaaaatgcaactttgcttgtaaaaaaagaaaagaatattagcaagtattttattttaataatggggaatcttagaacaattaatagcgtattgcattctaacaggatttttataatgagcagcctttgtactatgtcaccttatagcttccttttgaatagtgggatcaaagctagtgtgttatttgtccctggtgaatgtagtagaaatagaatctgtgatacaaatgttaataactcaacaggcatcccatctgttacaaaatccctttgtttcttgtccacttcttagaactctgccacagacccatcaacttcttgtaagtagcagagcactttgctgtgatgacagtagtttaacagcagtgaagcagagggtatctttttgtgtttattccaccccttccaggcctgaacaaaagcacctggctgtgctagtgaacagagagtgctgcttgcagagagggaggagcccgagggagtttcagtggtccgggagacaatggcatcagggacctctgctgctgcctacagattcacatgcagtattggcaatctcaggtcggctgtcggtttcacagtaagtaatggcatgagggtaaaagagaggaagtggctgagacttgagctggaatcgtagggcttaaataacttaaaaacagccaggatgcacaaaacacttatgattttgcctcaggtttgttatcacatccgttctcaagagactcactagtgagattcagatctttctttgtgggcagctggtagaggtcttatgagccctaattcccccagtaatcttagagggggatgtctggccaacccagtggagaaccttcgagtgaactacaaagaatacagcagaggagggagagctttacttggctgtcagctttgccacctgtttattataaattgctgaccatgtagccaagagcgtgaattttgtcattagccagacctgggttcaaatcctaacttggacactttctcttgggcaagctgcttaacctctctaagtgtcacttttctgattaatatatcaacgtaaatcaccctgggattgttaggattaaactaaaaaattgtgaaaaacagtcagtagactaacacatactaagtgcccaataaatgggtattttattattattatgaatgaaaattatgtatcccctgtatcaactggggtaagcagtattactctaattcaatatcttgctctaggaaacaggaaatttttttgagagtagcgtaaagggcaacatgctgacctgtctttactgagagtttgaaacctctaagtggaacacaaagtgaaatagtttgcagggattccataacgctggtcaagtgagtgttttcaaaacacctgggaagctgtctttttttttttttttttttttttttgagacagagtcttgctctgttgcccatgctggagtgccatggtgcgatctctgctcactgcaacctctgcctcccgggttcaagcaattctcctgcctcagcgtcccaagtagctggggttacaggtgccctccaccacgcccatctaactttttttttttttttgtatttttagtaaagatggggtttcaccatgttggccaggctggtctggaactcctgaccgcaggcgatccacccacctcggcttcccaaagtgctgggcttaccaggcgtgagccactgcgcctggccggaagctttctaaaaataaatattcctgggacctgcctccagatgatctaacacaaaattagacaaagaatgtccatttgtaagaagtttcactaagtgcttctaacaaaactagactggaaccactggttgagggtatttgtcccaggatttccaaatatgtagcatgaaggacaataggccacggtaagaaacttgatgcgaacctggaagtgggcagtagtaaagatggcagacagtgggtgggaggctggcaagatactggaaaggagagggatagaaagcagatagttaagtggtgatctgcaagttaagcaagaaggcagtcagctagcctatgaaaggtgtcagggattctggagagttggcagagcatggtcagccagacccatcagagggctacctgtaaactgaggctcagagataaattgtgcacatacttccgccagaaactaaaggcccttataggatgacatttttggatcctcccattcagccagcctagccttaaagggctactcctcctttattaatgctggtcctatataggtcctgacacagagagaaaaaacaccactgcagaagatgaatcatgagggaaatcaatagatttactttttttttttttttcggtttaggagaaagaattattaagccccctttacttacacctaagacaattgactttccccacattcccattccaatagatagaaattgccctatgaaactcagactcctcaggatatccacactgtgaattgcccttgacaattctgcagagccaagtgctaggttcaatagtatctattcaatatttagaaggtattcactgaatggatcttatatattgaggtggtgcttatttctttgtacactagaggctatttgtgggatacttacattttctgcacagtgcatagtcaataactcatgctgattgactgaggctaagactatataggtccatctgattaaccatttacagaattgatcagtgcttattatcttatatacacaacctgagcaagagtctttttgctcaaggcctaacttggctacttagtatctgactttcaccatgtcatagctctctaatcctagcttgaacagctgaactaccaggaaaatccattttatttcacatatgagtgttaacatttgaaggtacctgtgttatgaggctcaaagtttccattacagtgggttgcatcaaaattgtttcatgcactaagggaccccacagcttccagttctctccatcttcatcaccatcaccctagggtaagccatgatctctcacctcaactacaatagccacccaactggtcacttcacatgcatttatgccccctccccaaatctgatattcacattccaggcaaagtcatcttttctaaatgcagatctgattatgtcaacctactttccctccttccagatgctgtgctaaaagctttaaaaggttccaatagtattcaaggacaaaacttcttactatgactttcagtgctcagcagggtctgtcctctgcctacctgcgtcccaaatgccatcatgaactgtgattttcctcactctctgagcatcagccacatgtaaggttttagttcctgctaactgtggccataacttagggtgcagatacagattcatgctcattcccagcacagggcatttgcacatgctattctttgtgtctttcatttttatcagttacattttgttgatatatggttattcttatgataatatagatgacatctgtgctccccactagaatacaagcttcacaaaattagacactgtgtttgtacctctagggcctagcacagtgcctggtacataatagacagtcaacaatacttgttaaataaataaattaagactgtacacaatcaccacacattttcttgttaaccttcttcctccaacttcctgcaacttcaatacataactaagcaccagtattctcaagcaggttagactacacccttgtatggcatatcctctgtgggcatcattccatgttccagagctccctgctcccgaatgagaatatacctactcagtgtcctatttccttaatactttagtcttgaagcgttagaataacttatcaagagtaacacttaacttgcaatcctaaacaaaaagaacaaagctggaggcatcacattacctgatttcaaattatactacaaggctacaataaccaaaacagcatggtactggtataaaagtagacatgtataataatgaaacagaatagagaatgcagaaataaagccacatacctacaaccaactgatctttgacaaagtcaacaaaaacaagcaatagggaacagactccctactgaaaaaatgatgctgggaaaactggcttaaccatatgcagaagaatgaaactggacctctacctttcaccatatacaaaaattaagtcaagatggactaaagacttaaatgtaagatctcagactataaaaatcccagaagaaaacctaggaaatactcttctggacatcacctaggcaaataattaatgactaaaacctcaaaagcacaggtaagaaaatcagaaatagacaattgtcactctgtgctgttgattatctgcttataagggccagggcaatatctcaatcactgctatatccccagcacctaataaagagtagtttcttaattaaggcatgttgaatgagtgattgaaggaagagtccttgcaagtagctctggtctaacaatggaaccttctttcccaaaagacaatctcctttaccttctagctttattgaggtataattgatgactaaaaattgtatatatctaaggtgtacaacatgataatttgatatatgtatgcattgtgaaatgattgccacaatcaacttagtttacatatccatctcttcacatagttaccacctttgtgtgtgtgtgtgtgtgtgtctgatgagaacacttaaggtctactcttagcaaatatcaggtacactgtacagtattactaactatagtcaccatactatcctttgggtctccagaacttatttatctcataatttaaagtttgtaccctttgaccaacttctccctgtatctccaccccgatcccttctgctctctgtttctgagtttgactttttcagattccacatataagtgaagtaatgtcgtatttgtttttctgtgtctagcttatttctttagcataatgtttttcaggttaattcatgctgttacatatggcaggacttccttcctttacgaggctcaataatatttcattttctttatcaattcctctgttgatagacacttagcttgattccatatcttggctatggtgaacaatgctgcgatgaacacaggagttcagacatctctttgagatactgattttatatcctttggatgtatacccagaagtgagattgctggatcatatggtagttctatttttaattgttttaatgaacctccatactattttccataatggtagtgccagtctacattcccatgaacactgtacaagggttccaatttcttcacattctttccagcccatgtaatctttttactttttgataatagccattttaacaggtgtcagatgatatcttattatggttttgatttgcatttctgatgattagtgatgtccagaatgttttaatatacctgttggcaatttatatgtcttctttgaaaaaaaagtctattcatgtcccttgccaatttttattttatttatatatttatttatttatttatttatttatttatttattttttgagatggagtctcactctgtcgcccagtctggagtgcagtggcacgatcacggctcaccacaacctctgcctgcctggttcaagcaattctcctgcctcagcctcccgagtagccaggactacaggtgcgcaccaccatgcccagctaattttttgtatttttagtagagacagggtttcactatgctggccaggctggtctcaaactcctgaccttgtgatccacccaccttggcctcccaaagtgctgggattacaggcatgagccactgtgcccggccgtcccttgccaatttttaaatagggttatttggatttttgctgttgttgtatgagttccttatatattgtggatattgactccttatcagatacatggtttgcaaatattttctcccattctgtgggttgtgttttttgttcatctattgcttcctttgctatgtggaaacatttctgtttggtatagtcccacttgttaatttttgcttttgtttcctaagcttttggtgtcatgtttaaaacattattgccaacaccaatgtcatggaagttttcccctatgttttcttctaggagttttacagcttcaggttttacatttaagtctttaatccactgttttatatatatatatatatatatatatatatatatatattttttttttttttttttctgtgtaattctgtcttcattgaatgaatgttcccttctcttctattttttggaagaggttgagaagtattgatgctaattcttctttaaaagtttgatagaattcaccagtgatgtcaccttgttgtgaaattttctttcatggaatttattattaacattattactggttcaatctcttaagttggtgtaggcttattcagaatttctatttctttctgagtaatttttactcttttatgtgtttctagaaatttgtctatttcatctaggttatctattttgttgacatactattgtttatagtttatgcctaaaacctcaaaagcacagataacagaaacaaaaaatagacaattgttactctctgttgttgattatctgcctcttataactctttgtagttttgtaagatctgtagtaatacccccacgtttctttctaattttagtaatttgagtcttctctttttttctcggttagtctaggtgtaggtttgtcaatcatgtctttgacagaacacacttttgatattcttgattctctctactgtttctcttttcactatttaatttatctccactctaagcttcaatattttcttctttctatttgcttttggtttagtttgctcttctatctccactttcttaaggtgaaagtttaggctactgattgagatatttcttcttttttcagtgtagatgtttatagctataaatttccctctgaaaactgcctttgcttcatcctgtaagtttggggtttttttttggtgttgttgttattgttgttgttgttgtttagatagggaggttctcactctgttgctcaggctggagtacattggtgcaattatagctcactgcaacctcaaattcctgggctcaagcaatcctccccctcagcctcccaagtagcttggactataggcgtaagccaccatgctcaactaattttttaattttttgttaaaaatgaggtcttgctatgttgtccaggctgggtttgaactcctaggctccagtgatcctcctgcctcagcctcccgaagtgctgggagtataggcatggcctaccatgcccagctgtatgttgtgttttgtagtcatttatctcaaagtattttctaatttctcttttaatctctttgactcattaaagtgcgttgtttaatttccacatatttgtgaattttctaaattttatttgctttttatttttaatatcattccattgtgtttggagaacatactttctatctcaatcctaaaaatttattgatatttatattatggccaatcatatagtgtagcctggagaatgttccatgtgcacttgaaaataatgtgtattttgctgctgctaggtaaaaagtgtcctatagccgtctattaggtctagtcagtttatacagtgttaagtcttctatttccttcatgctcatatgtctagttgttctacccattattgaaaatgggacattaaagtctccaactattattgtaaaactgtctatttctcttctcaattctgtcatttttgcttcgtgtgttttagggcactcttattagttgcatatatatttataaattgctatgtcttctatatagattgacccttttagcattatatactgtctttctttgtttctagtaacattttaaacatttttcttttcttttttttttgttgttgttgttttgagatgaagtctcgctcttgtcccccaggctggagtgcaatggtgtgatctctactcactgcaagctccacctcccaggttcaagccattctcctgccttagcctcccgagtagctgggattataggcgcctgccaccacacccggctaatttttgtatttttggtagagacggggtttcaccatgttggccaggctggtcttgaactcctgacctcaggtaatccacccgcctcagcctcctaaaatgctgggattacaggcgtgagccactgcgccaggcctctttgttttatagagatagggtctcactatgttgtctcaaactcctgggctcaagcaatcctcccacctcagcctcccaaagtaccaggattataggcatgagccaccatgcctggcctatgtttctagtaacattttttgtcttaaagtttgtctgatattattgtagccacttaagctctttcttggttattgttgtatggggtatcttttttcatcattttgctttcaacctatttgtatctttgtatctgaactgtctcttgtagacagagacatatagttatattatgttcttttaaaatctgccaaattctgctttttaattggatactttaatccatctacttttaaagtaattactgataatgaagatttacttctataattttgtcatttgttttctatgtcgtattttttctgccttaatttcttcattactgccttcttttatgttgagtcgatattttagtgtacccactttaattcccttgtcattttttttcactgtatggtttgagttgttttcttagtggttttcctgggaattacaattagtatcttaactataaaaatctagtttcaatttttgtcaacaatttcaataatatacaaaaactttgctcctatatagttttatcttcctctttatgttgttattgtcacaaattacatctttatacattgagtccatcaatatagatttataattatcattttacacaactgtcttttaaattagacaggaaaaataccattaacactgacttttatattaatctgtgtagttacctttaccagtgttctttatttctttgtgtggattcaagttactctctagtgtccttttatttcacactgaaggactccctttggtatttcttctagggcacatctactagtgacaaattttgtcatttttttttggttttatctgggaatgtgttaatttctccttcaattttcaaaagtagttttgctggatgagcatagttggttgacaattgttatttctttcagcacttcaaaatagcatcccactgtttctggcctccatagtttcagatgagaatttaactattaagcatattcaggatcccctgtacatgatcagttgctttactcttgctgctttcaagatttttctcttagtctttggcttttgacaatttcataatgtgtcttggtgtggatctctttgagtttattgtacttggactccatttaggtttttggctcagtagattaaactttttaaaaatcaaaaattaattcaagatggattaaagacttaaacgttagacctaaaaccataaaaaccctagaagaaaacctaggcataaccattcaggacataggcatgggcaaggacttcatgtctaaaataccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacacatttacaagaaaaaaaacaaacaaccccatcaaaaagtgggcaatggatatgaacagacacttctcaaaagaagatatttatgaagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaaccagttcaacccttgtggaagtcagtgtggcgattcctcagggatctagaagtagaaataccatttgacccagccatcccattactgggtatatacccaaaggactataaatcatgctgctataaacacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggtctggggactgttgtggggtggggggaggggggagggatagcattaggagatatacctaatgctaaatgatgagttaatgggtgcagcacagcagcaaggcacatgtatacatatgtaactaacctgcacattgtgcccatgtaccctaaaacttaaagtataataataataaaaagaaatcattaccattattcatgaaattaaaaaaaaatcaaatttgggaagtttatggccattatttcttcaaatattctttctgttcctttctttctctctttctgggactctcattatgcatatttggtatcatgggcagtgtcccacaaatctcttaggctctttccatttgatttttcctcattttttttttcttttggttcctcagactggaaaatctcaattgatctatcttcaagtttactatatggttttgagttgttttcttagtagatcttagaattcttagtagatttcttagaatcttcaagtagattctttcatgtgccaggttaaatctgctagtgagtgcctctacttgaatttttcattttatttattatactttttaactccagaatctctgttttttctttgtaatctatgtctcttgactgatagtctttatacagttctcatggttttcttaagatttctggacaaagtttcttttagctctattagcatatttaaaatagctgacttaaagtttttgtctagtaagaacaatgtttcaccttcctcagggacagtttccattaattgccttccccctcccccatgtattggccatattttcttgtttctttgtatgcttcataatatttttgttgaaaactggacattttgaaaattatgtggcaactatggaaattagattctgctccttcccaggaaatgttgttactgcttattgtgatagttgtttgttagggactttcctggatcaattttgtaaagtctgtattttttgttgtgtatggccagtgaagtctgtgtagtgatatcccctcttgtatccttgatattggtaatttgtgttttattttctgttgatcaatattgctagggctttattaattgtgttaatctttacagagaaccaaattttgtagtattgtttctgttgtagcccactgatttcccttcttagctttattggttttttccttctacttattttgaatttatttggcccctctttttctagtttttttaaagtggaagtttagattatggattttaaacttctctttctaatataagtctttgaagccttaaagttccctttaagtattttcttagcttcatcctgcaaaggtttacatgatggtatattcattataacacagtttgaagtattttctaacttcctttttttgatatatcacctaaatgccctagacttgagtatgtttttaaacttccaaatatttgagcatttttttctattttttagaattatattttatgcaacctattacatattcttttttttacagctgtattgaagtacaattgacaattaaaaattgaatatatttactatatacaatgtgatgttttgggatatgtgcacactgtgaaatgatgactacaagccatggaattaacctattcatcaccttgcataatttctttcatttatttgtggtgaaaacatttaagatacactttcttaacaaatgtcaagtatacaacacagtattgttaactatagtcaccatgctgtattcatctcaataacttattgatcttataactgaaagtttgtaccctttgaccaagatctacccattttcccctcctatagcccctggtaaccatcattctgattctacttttttttttctcatgagttcaacctttttcgattttgcatacaaatgagatcatgcaatatttgtcttcgtcttatttcatttagcataatgacctcaacttttttttttctggttggtcattttattttacttattttttattatactttaagttctagggtacatgtgcacaatgtgcaggtttgttgcatatgtatacacatgccatgttggtgtgctgcacccattaacttgtcatttacattaggtatatctcctaatgctatccctcccctctgcccccaccccatgacaggccctggtgtgtgatgttccccactctgtgtccaagtgttctcattattcaattcccacctatgagtgagaacatgcagtgtttcgttttctgtccttgtgatagtttgctcaggatgatggtttccagcctcatccatgtccctacaacggacaagaactcatccttttttatggctgcatagtattccatggtgtatatgtgccacattttcttaatccaggctatcattgatggacatttgggttggttccaagtctttgctattgtgaatagtgccacagtaaacatacgtgtgcatgtgaatgacctcaagtttttaaatttgattccattgtggttaaataatacagttaaaatttttgaaatttattgacattctatggtccagtacacagcctatcttgatgaacatattatacatgcatttgagaatgatacgtattccttatgtattgttctaaaattatcaattaagtcaacttggttgataatatttttaaaatattctatgcccttacaaattttttctctagtgtttttatcagttatgccgtagcaatattaaaatatccaactataactgtgcatttgtctatttcttctattaatttcatcagtttttgctgaaatagtcttattagctaaacaaacagatatgattgttatagcttcctgatatattaatcatttaataatatgaagtgttcctcttaatttcaggcaatactccctgtcttgaagtttattttgtctaataatgaaatagacacacaagcttgcttatgcttattgtttgcagcatataactttttctatacttttattttcaacctgtttgttgttgtatcaaaacacattgcttgttgtagcatagagtaagatcatttttaaagcctgtctataaatccctgtcttttaattagagagattagtctaactccatgtaaaataattattgacatgtttggatttaagtctgccactttgcttttcaatttatattctattggttccatttgatattttgttcttctgctcctcttttcttgtcttcttttggtttagttaattattgttattattatgttttagagacatagaatacattcactctgttgcccaggctggaatgcagtggtgcaattatagctcactgcagccttggactcctgggttcaagtgatcctcctgactcaacctcctgaatagctgggagtagttgtgcaccaccatgcctggataatttttctcttttttttgtaaagactgggtcttgctatgttgcccaggctggtcttgaactccaggcttcatgtgatcctcctgcctcggcttcccaaagtgttgggattatgagtggggcaccatacccagcctaattaatttttttttttttttgagatggagttttgctcttgctgcccaggctgaagtgcaatgctgtgatcttggctcactgcaacctctgcctcccaggttcaagtgattctcctgcctcagcctcctgtgtagctgggattacaggcgcctgccaccacgcccagctaattttttgtgtttttagtagagatgaggtttcaccatgttggccaggctggtctcaaactcctgacctcaggtgatccactagcctcggcctcccaaagtgctgggattacaggcgcgagccaccgtgcccagcccagcctaattaattttttaaagtatttcatttaaatttctctaatgacttttaaatttgtcttctttgtattatttgctagtgtttgctctagggattttgatatgcattcttaagattttacagtttacttagagagttaatattgtaaaacaaggatatctacctttattttttaaaaatttgattatgaggtgcctgtttttgtcattgctgttgtttgttttatgtatttacagtggagtttgtgtaattcttagaactgtacattgatgcatttcaccaaatttgagaatttttctgccattatatcttcaaatgcttttgtgcttcattgtctctcgcctctccttctaggaatccaaatgcatgtatgtcagatgcgcagtcttatttgcatgaggtatagattggggtaggcaaattattgcctgcaggccaaatctggcttgtttttgtagggccctcaagctaagaatggtttttacatttttaaaagatcataaaacacaacaaaaaggaaaacaaaaaagaatgtacagtagagaatttatgtggcctccaaaacgtaaaatatttattatctgaccctttacacaaaaactttgctgtctcctctgttagagaatggtgtttggggctgctatagtgactgcaatttggagggggaaatcctagaaaagagggagccatagatggagggagcttgcaaatctgcttgcaaactcccctctacccccgtgatgctcagactaggtattggtgtcagggaaaaaggtgtataaatgtgatcctcaaccagcatgatttccttctttcaaggatcaaggcactttctattttctgatagtatttgttatctctccagttctttcaagtagcagttatgtttatatttttcccagagtttataattgttatctgtgggagttttgagatacaagccactgttctattccagaacttgccagactcatttttaattaaatagactataaattagtttaaagggagtgataaaatggggaaatcaattaatgctttatactcagtttattcacccaggtgttttagtatagagtttggggctacattttgtcacctcatgcaaggaaacatcttttaatttgcacctgtatctatggaagaaaactgccaaaatcattaggataaggctatgccccaaatattcatattttaaaactctgcctcaaaattacagaatcagaaagctggtatagacctcggaggatacactcaatatagaaatcctctttacagcatctctgatgggtgggctttcagactctgattaaattctaggaattaaaagcgtcacagtttttatattttctataatatatcaatgccttttgattcaaaatgtttcttccacatcataaggtggctgatgtaattagactcaagatttaggaactgctgagctatggatcaaagccagttttcttccatctctactgaaatgggtttagtttttgcccttggactatggaggcagctctggctcagaagtgaacatcccctttttaaaagaaatgtgaatggtacccaggaattcatggccatgtttgagggctgttctaagttctgagctaaatccctccaggcaatcactgcactgaggaagcagctcacactggatgcccagagaaggcaacagatgcactatttttctgacgtactgttctccagtttaatattgggctggagtacctgtgacatgtgggaaaccatagatatccacttacaaaaacattctccagtaaacatattcatttatgtgtggcaaatgcagttttcaaagatatttgcaagatggctgtgatcttccttttcagtcaactgaattttaagattcaaattaaaataaatattttcagcatgaattagccccttcaatggaaatcttttaaccacttgacaagatgcggagctatgtactttagttatcctgtatttctgtctacctactggtatccatgtactttaatgggtaaactggccatcaagtaataatttgtggccctcatttcatgtgcaggctcatgctgttgctctagtattataattttacagataaataaagaccatatcttaatatttgttctctaatttcattgcaagttacagggaagtcgttagtcatatgaagatttacaacttgaaaatatagtttccagctaaggcaatttatcacccacaagaattctggggaagaatactattttcatctgtgttaattactgtgctatcttactttcatttccatttatgtgcttaaaagatttgcttgcccacaatctcattctattttctgtatctacaaataagatatctcagggatgttcaggccctatattcctcaagtgagaaattcaaagataaaagagagtttttggttaaaaataaaatacttaatccacattttggggctgagagagacagaaatcaatcatagatcttagatttagaataccctaaatctaccacatctaggttataagccagagaaacttaaacttcataagattctcttctttccaaaaagtgagagggagagatgggggaggggagtgtggagaagagcgagagagggagagacagacagagagagagagaggtttttgtgtcttgctaaatagcatatttaagacataaatgctaaaaccatagaagtctcttgaaaattctttttctaaaatagaatgtgggaagaaatcatgtttctttgaacctttgccaataaaagggtgtgtgtgtgtttgtgtgtgtgtgtatgtgtttctgtgtgtctgtgtgtgttgtgtgtgtgcacacaagcataggtcagggccagaccaactggacatttgtcccatttctctcatcagtgttgtctgtaaaactcatacagtgttctacaaatgaaagaaaaaaaattaatgctcctattattacgacattcaaaccactcctcctagtgctacattaacaagtctttgcacgtcaaggagtagggccggtggtggtggtggtggggaaaaatcaggttcctgatccctatggccactaccaatagaaataagattatttttagcaattatcaaaatacagtaacagcatcttttaaaatttgttctcaatgctcaatttcacagtgacttggcttcactgttcgaactttataagatttattcccaccatttgctttgtatatgaagttcaggaagcagcagtagagacagttttttttgaggttcagtgggactggttcccccggctgtgatattattgcagatgctctgctagtcacacacactgacatctcctccagcacacgtccacactccaggaagcgaaaagggaagctttgtgtcttaaggatggtgtagttttctgtcaagcttctctaactttatagaaatagctgcttcttaagcagcccctgtaagatctgaggcctagagatcaacctaggggctagttattggttgcatacatactgattcaaagttgtgctaattctcaaaggaatctttatagagaattgccaagaactgtcaaaactccattaaatatgttattaatgctaactaaactctctatgcttacaggagatgccccaaagacattagtcacccagtaagtcactggttattgaacattagccaaatggcctagtctataatcattatgttgggcataagctgagtgctttagtctccttaaggaaatatttctcttcttccccaaccacgggcagacccagatcatacttgcattgcaaggagtaagagggactagacatctatttactccttagttgaaaagaccaaggggcttctttgcttgaagtccaaaatatttagctgtgatgaaaccttacttaataaaatgaatgttgatttatgccattttcatgatagcctccagctgacatgtaccattcatagattggcatttaaaatagatgaagatggacaataagtagactttaatattatttcttcaagggcgtggataaaactaaatattttggaggcctttatgcacacacaattgagtggttcttacagcattattaacatatgaagctcttagtgccggttttctctcccaaatgtgtgctgcatttcaccacaggcactgaaaaatctgttacgttttataggccgggcagacattggaactgcagtaatacatttttttctatttaggttgcatttgtgtgtcactcatctataataagaatctacccattagtatctgttttcattgccagtagatttctttctttgtctgctccccaaggtggttaataaaatgatttttacagtgaaacaatgctagatttaaaaaagtgtaacttagtgatcggatatgaaaagaaaattcactctctacccccattttaaagaggatttagttaatacttttaagacatctgagtaatttaatttatataacgttcactcagatagcccatgtctcagaaatcatcccaagaaaataataatggttgtgcacagtatgcatccacaaagtgctcatctcactgctgttttcaatatcacagtactgaaaacaacctaaatgcctcacaataagacattgtgtcaaaaaaaataagggtgcaaacgtaccacagaatactattatgaaaacagtacaaaagaaaccagagaaatacattttctgaccaggaaagaagcttaaaattggtacactcatatgttttcaacatgagtgtgtatgtgtgtttgtgtgtgtgtgcgcacacacacacatttacccgtgtaacacacaacttatataaattcactattggcttcctctgagtggaaggattttgagtgatgagtgatttctgttttccttctcccacccacctcctcaaacaacaactatttacttagctaaaaaatatgtaggtcaacaatttcggctgtgttcagctgggtgttgctgcagatctgtgtcaggcttgggatttttgctatgactcttgcctgtatctatgattagctgctggttgactggtggctggttagctgtttgcagagatgtggtcttgcatcttccagtagactgccttgggctcattcacaccatggtgatgttccaggcccagcacgccagtaagcctcaacgcacaaatgctttccaatctgccttttcttctattaaaaaaaaattttaattttggtttaaaaaataaaacgtaaaataaattttaccaccctattcattttaagtgtccagttcagtagtatcaactgtattgacattgctgtgtaacaaatctctagaactatgtcatcttgcagaactgaaactctatacccattgaacaacatctccctttttccctcccccaaatccctgacaaccatcactctactatctgtttctatgaattcaactaatctagatacctcatataagtggaatcataaagtaattgtctttttgttattggcttgtttcacttagtgtaatgtcttcaaagttattccatgtggcatatgatagaatttccttcattttaaaggctgaataatattccattgcatgtatatatcacatttttttaatctattcatccatttatggacatttgggttgctttcatctcttgactattgtgaataaagatgtaatgaacatgggtgtgcaaatatctttgagatcctgctttcaatgcttttggatatatacccagaggtaggattgctttattacatggtatttttattattaaatttttgaggaacctctatactgttttctatagtggctgcaccattttacactcccaccaacaatgcacaagggttccaatttatccatattcttgtcaacacttgttattttctgttttttggatgagaaattagtggcccattagtggctatcctactgggtgtgaggtgatatctcattgcagttttgattttcatttctaagtattagtgatgctgagcatcttttcatatgcttttggccatttgtatatcttctgtggagaagtgtctattcaagttatttggctctgtgtgtgtgtgtgtgtgtgtgtgtgtgtgtgtgtatgtttgttatatataattttctgtaatgagcacttatttttgtattgaagaaattattagaaacaataataataaaaaaatcaatgtatcaagcaagttgttgcagtaggtaaatgggccaatcttgagtggttagttgggataacttaggggtggggccactgtctttacttagaattaaacaattcaagaacacttaaggcaacacatacaaaggcaatttcattctaaaccaagtcccctctaccttttgcggatcaattagctcaagtgacataaaacagggcaggcaggggattaagtaaatgaagatgagctggcaatgcagccatgaagcagcaacagtccgtgccctaaatccatgtgaaatacctggtgatcttgtatacaaagtcttggtctggatactgcaaatgattgttctcttggggattttgatatttaggagaaaactttattatgtagtcaagggttatagcttttatctgaccaattcagaagaggtaactagctaaatcaccaataattttgtaatctgggtttcaagaaatgctctgcaagcattttagggtgcaactttgtataaaataaagataagcaaagaaaagctcataacaagctttgaactttaaaaattctatcaaaactttaaagctccagacttaaatggtgaatgaagtgaatttcccaaaggtctggactggtgactactagcaaacctgctgaatgaaataattaccttgaaagaaaataatgagggataatggcattcaaacctgttaactgggaatgtaagctctgtgattttcttggtggacaggctaatacgataacagagtgatctgagcaggtgtgaacacattcattctgcagaagcaaatacaaactgaacatgcaaggtaattatggagaagagatactggattcaatgagcaaaccatatgtaaaaatagctctattcctgcctttgaattctttctttattggagtcctagacagcatgcatgtcaaagtcccgtacttggtcttattacaccacaaatctcttccagtaatgtcctgcccctcaccctcagtatcatctcattttctgtacctctttctttctttgtgttaaggttccatttctctcttccttcacattctaatacctaactgaaactgcatattggaccacattacgttctctcactgtccacctcctctgcatttcactatttctttctcttttattcaacctgataagcagcactttatgacagcttattatcttacagctgttaatgttctatatcattttcaatcattccccatagttttgactacatcgtgtctcagctcctgtgttttggttcagcaacagtggtttggtattatagtgtccatctacctacaacattaatattacccaccttctcttcctcctgacttatttcctctaggacaagtccatctaattatccagtcttctctcttgctttctgtgccacaatgctctctacttcctaagatcagtgtcctatttcctttcttgacagattagcttgttttttttctagccacagagccttacactacatttattatatggttcatcctcgtcttcactcagcctcccacctctagtcgctggttatggatcacagtattctattagcttctgatcattttttaaccttcttcttcccctcctctagcatatataaggtgatacacccctgaaagatattttctttctattattccaaagtaagaatgaacaaacatgaaataatttatcattctataaccgtcctccaccccctcccttccaaattcaggtctcctttttctctggtgagttcaaactgtcatatgtttatttagcacattttcacattcaaagcatttaaggagctaattaatccttagagtacccttctgcaatgcacctaggctatagaggcagttgacattaaggtgggagcaaagctcaagaatttctgttttccaaatcactgttcagactacattttctttcactctgtctctctgtgattgaaataagtaccatcatgaataaattatgttgattaatttataaggaagctgctagaaaatgggtgactttcctggtactcccaatttttctatcagatccatgttagtcttctatgagcagctttgaggcagctgggaatcaaaccacagaacaagatgaaaacataccatgtttttctttctttttcatccagaaagacagaattattcacctatatctgtaattacttcaagtcatttccaagaatacagcaagaagatcatgtatgtggatgtgcgtacaagtgttgacaaaacgtggatgatgaggggaagaggactacgttgtagtatagttttatgttggtctggtagatcacattattacagacacaatgagtgagaggaaagagctcccttatccccttaccaggatctctttgcttttttcataaaagaaaaagaaaatacactctttcagccctatggcttatatgctatatgaggccatttgggatttatagtttggctattaaggagggaaacgagttattgagtgccaaatcactgttttatctggctgttattattatgttaccaagcagtaaggaagggcttttgtataatgagaaaaaattactagcaattaaatgatgttctttgttctttttttcagttcaaatgcaataggtaattgtttaactgttacatccaaattgtggaggccattggtgatcattaataaataaactgtatgtgcaattgcatactgaagaagccagctcagtcaacacttttttgatcagataaaaaatacagcaaacaatcttaaacatattgggctcaattactattgccttgccctgctgtagacattgctcttcaaccccttgggtagaatacagtcatagttgaaagaaaagtcagattaactgaaacttttcctgttcatgaacattattcatagaagaatagaccatttccttttgagaggtgaagggcttttgtggtgcttattgaaagatgcagggagtttgccatagctatattggtgcaattttttttcaactaataggtcaaatagtcatcttagtcagttatacttcacatgggttatctcatttgatattcatttatctccatttgcagatgaggtaactaagcttgggggattaagtgacttggaaaaatttatatatctaggaaatggtggagctgggaagtaacttcagaaagatcgctcctgactattatattgtatcacctcatcccaggctcaggcatgggagaaggcccagagttgtgttttaaaactgtaattgctaataaaactttctttgaagaatgcaattgaatggttttccttttatgacatataaaaatgtccccaagtaaaacaaacacacaaaacaaacaaaaaatataaagtaccaccctttaaaattgccataaattctcatctattcatctctttcccaaggctcaaatcttcacatctacctggcaatgatgattagaaaacacatgcactgtaaaaaatgctattccattaaaatattacctggttaacagaatgctatttgtaaagtcaacaagatagtaacaattcatttgtgatttgctatccacctagatggagtgagcatgttcttcagacctgagctatagaaatctcactttctctaataataacaatgcaaaaaccaaaccaaatcaatgtattgcaattataatatgaaggtagccatgacagctttcactgaatttcacgcttcagattcatggcaattcaacatcactaaaaccaagcaagaatttctgttcattaaaagccataaagaaaataaatgacaaactataatttggaaaaagatatttgcaacacatatgacgaacagaggattagtatccaggctttacatgtatacacagacacacacatacacacacacacacacacacacacacatatttttatgtatcctttaaatcaataagaaaaagagataaactcatagtaaaatgagcaaaacacatacagttggagacatggacaagaatgtttatagaattgctgttcctaaacttctttttgttataaattacccagcctcagtattcctttacggcaacacaagatggacgaagacagtacccaaatatcagccctgaactggtacaaaccaaagttgtattaatagtggaatggattgatagattgtgttatatcctcaatactacatagcagtgaaagttagcaaagtacatcttcacaccaccagtcagatgattctcaagacgttgcatgaaaaaagcaagtggaaaaataacatgttcttgttttttaaaaactatgctccaaatcatacaaaactaaacaaaatgttatatggagctataaatttatgtgacaaaactatgaagaaatgcaagagaatgctaaacacatgattcaaaatagtgattacctctcaggaggatagacaggcataggatcaaagaagggtactcaggagacattgaagttgacagtcatttgttatatttaaaattagttggtagtagagacacatgttcattgtatcattattctttataaatgtattaacatttcatgaatattattttgtacctcaatattgagtatatatattttatttatttatttatttattttcgagacagagtcttgcactgttgtctgggctggagtgcaatggcgcgatcttggctcactgcaacctccgcctcccaggttcaagtgattctcctgcctcagcctcctgagtagctaggattataggcacctgccaccacgcccggctaactttttgtattttttagtagagacagggtttcactatgttggccaggctggtctcgaactcctgacctcgtgatccacctgcctcagcctcccaaagtgttgggattacgggcgtgagccaccacgcccggctgagtatatatattttaaagatgtgatgtaacattggttaagatagagagatctaacccaaactctgtgggccaacatattttgaaaaggaatttgtgatgctgatctattccttcatgtcagagtgcttccttatcctacaatgcaaccatctagccataatattcaaagatggggaatacatcacccctcttgactggatcttctatccaagggaaaaaccagagccttagacaagcatatgtagagagctaagtgtgtattgtgaaaagtgggacaaatattaaattgggtttattcagacctatggagtgtccattgtaggcctcttaattgcatttccagactgaattcacagcatgtattccttcacctattccaccccaactttttttctcaacttcaggcccacactgtttcatcaacgtattcttttatttacaatttgttttcaacagattgagggggaatggacacgaaaccaacaagcaggcaccaatctcaacagttaatgaggcagggaggcataacaaatcccaaaaattatttctgaattgcaaatttgccatgaaagctgaaaaaatgactggcttcctctgatagacttgcattgccataaatgataaatgaagcacagatttcattattcattttttaaagtgaaattagcttacactactacataacatttatttaaccccttttaaaatgcattcatttaatagccccagaaatcatcaataaagaggaaggttactactacctagcctatcttggagcaatttaaactcctgtaggcaaacttcctcattatcacacagccataacgtgaccttggggggataggtgaggatgtcactctgtatttctgtacttggacttcaccatttacctaagacaaatttttagattttttgtccaaaatgtttcttacctcaacatgatataagttgtcaggcaaatatgaatttatctacatatctcattgtggggccataagcattccaaaagcatgtggtcccacagaaaagaggaatgaaaaaaaatggtatttttaatactctgattagtaataaatacatcctaagaaaaagtcccagatacggggtctctagatatgaaggagttaggggtagcaatgagagggaggatgagaaagcagaatgaaatgaggagctctcagcaaggcaaagcctggtggcagcaggtgccctgcagtgtactctaaattagtggttagcagctttcctttttccagttgcaacatacaagaaggaggatgttgaagtctaatctcacatctttgaatatgcccagagttatatgaaatactccatttcctgtgtgtaactctgcccctttctctaccacccaagaaagcattaatggaacgtgagtaagtcaaagtgatgcccttaggatagctttgatttcatgctccctttcaaaaaattaaatgataactgctatagttgggatgtttgtcccctctaaatctcatgtggaaatgatctctgatgttggaggtgggacgtaatcggtggtgtttgggtcatgggggacccgcccccatgaatagcttggtgccctcccggaagggtgagtgagttcttgctctattagttcccatgagagctggttgctaaaaagagcctggaacctccctcttctctcttccttgccttctcccttgccatgtgatccctgcatatgccagatctccttcgccttctgccatgagtggaaacagccctgaggccctcaccagatacacatgctggtgccatgcttcttgtacagcctgcagaactgtgagccaaataaacctctttttgttataaattacccagcctcaggcattcctttatggcaacacaaggtggatgaagacaatacccaaatatcagtacttaaagtattattttcatcaaattccttgtgacatccctaacaacttatagatatacataccagttagtgccgcttctagttgcactctgtcatctggcaaattctacaccttaatttttatggctagagtctgaataagaagtgatctcattcttttaatttctcatatacccctgggtctggtgctgtaggtaatgcaatgataaatacttctaaagagagattggcaaatggtttatacagtgttcttagaataagatgctgaggaggaagaaatactgctttttgaaaggtttgcccttccataagagacaacaaagaatgtgctttgttgactgactctagacagatttttacccattttgttattttgttctattccactgttgctgtatgtttttctaacttttttgtttggcaattgtgatctatgagtatgtctttaaaatcattgaaatactatttgagcctgggaatttcttacgtgtatacaatatgttgtggcatatggagagtctaggtggcaggcaatttggatagtggccacactcactaatcagaagacagacttcacatgtgcttactttggaaggtactattgatcccacagtgacctttccagttacactcacacacagttcataacgggttttcaagtagtgtcaatgcataaaaaggttaactgagatttaaatactgtgtaatggttaaaggccaatgactggggaacctcattggctaagcttgttacacctcacaaccaatgggactgtgtgtcattttaaaagttgttgagttttgttctattgctacataaagtcagcaaatattatcactattaatgacagctataatgatgataatattgcccaggcaccttgctaagcccttactcttggaggtaggaagaatattctttattttacaaatgaggagaccgaattacagaatccttaaggtacaagtaaaaaaactggtgtttgaactatgttgtcttgtattcttaaccaaaatgaaatactgcttccccagtgggcctttctttttatttgttcatttcatatggtagtctgagcatcagctcggtctcatctttattaagaatgtgattttttttttccccaacgcatttgcaactttcattaaagcacactacttgagcccctaacatttttaaataaagataacttacctgtgattttggatactccagaagacacctacttacctgcctatcctatctaccattccagatgcccctggttgtccaagatgagtctcatggagacctggagccccaaagtatccctaaaccatgtgcccagggcccaagatacagtactagggtcactgggctcccctgggattgaagacagtcttccttaggaatcttttattaggaactaagaattcccatttgtttgatgaggtttgttgaacacatctttagaaatgaagaaatctctaataaagatgattctcaacctgtgaattagctatgtttaatgactcatcccagaccagctttgcacaactctctattttatgcttcttgactgtttctttgactgcccatctatgtgtgctgagggaatacaaatttaagtttagtaggagcctgagcaaaatgtaattgagaaggtaacttccctccaaataatattaaaggtaaaatagaaatgatttaaaaattatcagtgttacattcattgatgtgaataatcaagaaatgactatacagcctcatattttgggccccagtaattcacaatttgtgattaaattcctgcgcagttcctgttcaaattaccactgcactatctctgaatgaatggttagctaagcaaagtaatagtgtaaacaagtttgcaaaggggcatgtttaacttgggagggatcgatctctttttaaaggctttgatacattaattatttacactgaaattttgtttttgtagaactgatcagtccagttacaaactggagtaattaggtatatttaaaacaactaaaaacaaccaaataacattcataatacatttaatatcaatggctttttggtaaagtagatcatgcaatttcatgaattgctttattattaaagttccaagacttagtcccctggcttaccaaactgaatcttcgactctgggcacatgatttagggacaccttgaggcttcaggtttctgtgagcctccccattgacaaccaggggcatctggaatggtagatgggataggcaggtaagtaggtgccttctggagtatccagaatcacaggtaagttatctttatttaaaaatgttaggggctcaagtagtatactttaatgaaagttgcaaatgcattgaaaaaaatcatattcttagtttaccagagtaagggtgagacagaactgatgcccagactctaccatataaaataagcaaatgaaaaaatgctttgaaaccatttaggggagaaactctgatgttacatatgcccccttacccttcctttggctttttctaggtgtttttttatttcgtttcagttgccagaaacattttaaatgggttgagacaaggggaaacaaggagtgtttgatacatgatggcaggggaaactaaaaaaagcttgacttggttattttctccccacctccaacatatacacagtacctgggacagagacagccagttgacactcaatagctgttctctccatttgtaatagaatcctgaatttagcagaaaacacgcttaatactacatttcccagccttagaattgtcacgtggctaaggtctgtcactagtgtataagttaaaatttcacatgtgacttctgcagtgtccttaaagaaaactgatgcactgtgctttcctctctattcctactgcctggagaggtgacatgatagccagagttaaagcaatcatcttgggtcataagcatgagagacacactctagggatgatggagcctatgtacctggtaactacgtggaactgccaagccatccctatattgtcaacctctagatttctcttgtgggcggattaagctttgtgtgtttaagccactgttaatttgggttttctgtcactcacagctgtacctaatcctaactgatacagcatttaatcaagttctttcctaatagagggaatctattgcatggacaaagggcagagaaggccctttggaaggggattatttcttggtgattttattgacaccaggtcaaagcagtcttgtgtttatgaaacatatcatgggttgtggaaatgactgaggcacttagcctctttgtgtcagtagcttcacactgccaacattttgcctttgtgcgtaccacttgctggtttgcaacaacagatacaactatgaatccttctcgacctatatattaactgtctgaatgcaaacttaatacaaaccgggttattctctaatgattgcagtcaagatgggaagagtggaatcttggcaatgcaatctatcactatgccaaagaccctatgattgcctgtttcagtaccacacactagaaataacctgtaagagaaaggcagacctactttgcttgcaaattgctaaactcccctcctcatgtcaccattctggaactgttgaattacatcaaaagtttacaacccaaaattgatcaccttggccaatttacacaagaaggatcaatataatcagttcccccctctttaaatgttaacaaattctttaacataacacgcctgaccatgggatacagattaaaattagatacagaattaagttccttcttcacagtaaaagagtcgatttgaaaatcctgataatcagcccgagctgcccacaaggcttggctttatagcatttaataagaaaggaagcttgcttcccacaaacgtaatgatttttgtttaattcagtaaagggaaagacagaaacaataagtgggttagggattctccagttaatggtcactattccatccaaggaaggaacagctttgagctctgtatggcagatccctgtccccatcctctgggaaacacctgtcaaggagagtgtaaaggtccccattcatctcctccttctgctgagagaagggctgcatcgttgtcaagggtatgctagactagccttacctagaaaggccacttctacacatacacacagcaaagaccatgatcatcctcagacaggcgtgaccgaagtcaagctcagtgcaacttctgatggaatgatgcatacccaaaagcttcaacatgggcctatctactacttggaggcagaacagacttgtgggaaaattgtaaagtagtgccctcttccccttcttctgcttgtgatatctctaacagaggccagtgccttccagatcccattgttctctttccattccagtcacactttatgtgagctgtgatgttggataggtggttacaagtgaactcacactcattaagtttgcatgttaggcgtggcgtggtggctcacgcctgtaatcccagcactttgggaggccgagtgggtggatcacttgaggtcaggagttcaagaccagcctggccaatatggtgaaaccctgtctctactaataaaatattagccaggtggggtggcgcgtgcctgtaatcccagctactcaggaggctgaggcaggagaatagcttgaacctgggaggtagaggttgcagtgagctgagatcatgccactgcactctagcctgggtgacagagcgagactctgccttaaaaaaaaaaaaaaaaaaaaccaggaccttataaatgagtcacaagggtgggaaggcagatcattgctggggaggctgaagtaatgaatgacagttattttctggattacaaaaggcaacgttataaaagagtctatgtttctggagtccttgcaccaatgcttccctatatttgccctccttcacaagcctccctctggctataacctggttttatttttttctagcttctcttttcaataccaaccaccaccacttattgcatgtatgctttgtgccagggactctaatatactttacacacacatgcacatagctcatttcatcattaaatgaacccaaatgagataggtactatgtcatctccttttcacaagtgggaatgatgtgacaaagaaaggcaaaacaatgtaaacaaatacgcattcaactaaaatacgaactctacaagtgtcgggatttttgtgtttttcacactgtattttgtacatctagaaacaatgtttggcacataataggaacacaataaatattgtacctacctgtaagaagtagtatttttgtctagagtcaattatttaaaaacaaataaacccactcaagctaggttaggcaaagggggatttaggttcaggaatacaggaaactttgcagacccccccaagtgacaggaaatacagccagactacacggatactaggaagtgttgaggcagatcatttgtttctgtctgtccctttggggccatgaggtctcccatacatggtgcgtctctgttcctaatttcttttctgcagatagaagcttcactgcaaagtttacagctcctctttcttcacataagcttgcacattaatttggtttgctgtaatagtaactctgccttcaatttcacagataccaggtaaaacgttgtttcccctgcccatttccataggcaattgggccaggtttccatcccagaccgtattagctgtgatcagtaggcggagtcatgtgagccacccgttccaaccagcggatggatcagatttcctaaagaggttgtgtaggcaaggcaaatatgactgacatctctcaactaggcaggtggccagagacccagagtcgtgttagaagagatatgctatatgccagaggcttctaggacagaagtcagcacactacttctgtaaagggccagatggtaaatactttaggttttgcaggccagacatgattgcagtgcaaaagctgccatggacaataagtaaaagaataggtgtggtgatgttccaatacaagattacaaaaacaatataacaatataaaaacagacagatggctggatttggcctgagggctgtactttgcagactcttgttctaggacaaaggcctcatcagtaaatagaacacttatccatattgctagcaaactggcttcaggttctctgaacaaacgatattattttgtttttactgatttcttcttgtctttaatcattaatgaattgcagtgaccttgctgttatgatgtagaacatcctgctaaacagggaatgtaaatactttgctatatgataaggagggtgcttgaagaaccaggttatacctatcagagccgtttaaatgggagtgagtgattatgctacctattgctaaagtggtgtaattatccaaggacaaagggctgtttttgtggaaacaattcattgccatccctccccacctcttgccaaccctctatcaggatcttaagtgagacatatattttagtgggtgctgtgttctctcactcatttcatagggtacctctttccaaggtctcttaatatagcatgagaaataaaataagggtccaaaaaaggatcggaactgcaaccaatgtgtgtcgccattgactgcatggattgtttgtcaagtagaaaggcagagttttaaatgtagttttattttaaagagtcggtgtttgtagatgcagcccatgtagctgggctaagcttgtaataacttcgcaagtgctgtgaagaagccccaatttctctctgaaagtggttttgtcatactgtaatataaaaggataagggagtaatcttaccgtgtgttgctgggtggatgctgttcctgcagtttattatatttaggtaatgcttaactgcacacttgatagacattacttttatgttgtggctcctggactgttttatgctccccggccattatgctaagaaatgaggttctcttacctttcagagttaaagtcccctgctcctaccccatgtccgaataaaagactctgacagtgtaactatacaggtaagctctcactttctcaactaaaaaagaatgagtctactctgaaagtcttggggcccttaaagtggacggatttgtcagtaaaataacagggagtcagttgagtcaacacattaattaaatgcccttatacagagctgtcctcaaaataaggagccattgcccagccactggtggtggattggggggggaggagaaggcaatgagggtagctgtggtaagcactagttcctaattatacatctcttcaaagctgaggttgagctgcccacttccacgtcactcctcccttaggcagcattatgcttccctgacttctcccttgacccccacccccaccttggtaatgagctatgttatgggtaacttatcccaagaaaagaaagatcatgaggataaatgatagatctggcctttacagccaaaacagtttctgcgatccaattctcttaagtctggtgttgcagaatgacattttaaacacttgaagaatagcaccttcagtaaattggctttaggttttttgttctttgtttttaataatctcaaacttatagaaaagttgcaagtatagtacaaatgaaatgtttccccctgaaccatttaagggtaagttgatgcctcatcaccccataatactagtttagtgcatatttcctacaaacaagaacactgtcctacttaaccacaatgctaccacccaaatcaggacattaattattactatctcaccctcaaatcccattcaggttttgccagttgttccaataatgttttctatagcaaaaggatccagttcagactcaggtgtaacacttgattgtcatacttgagggtaaagggggccatgactgtttaccgtcctttagtctaagatgtttccttaatttaattttgattttcttgaccttgacacttcaaagattatgggccagttgttttgtcacttgtccctcattttgggttgtctgtttcatcctaattaggttccagttatggacctttggtaggaacgtcccagaagtgctgctggatcttctcactgcattctatcacgtggcatgtcatttctacttgtttcattcttgttgatgtccactttgataacttgagtaagataatgtctgccagacatctctgatgtaaatttaatctttccccatttatctcattttgtaattctttagtttaaaataatgttagacttacagcaaatatatagcacagagagtgttatatacccatcactcagttcccctagagtaagcatcttcaattaccatattaatattttgggagaaggtacattgaagccacgtagaaatccgttccttgtcaagctttcaacatattcatttaaaagtgtatctcaccataaactcatggtttcctattttctccaaaagataattaccattaccataaataactatttatttatttttattgaggtggaactcacataacataaaattaaccagtttaaagtgaataattcagcagcgcttagtacattcatgatgttgtcccactactacctctatctcgttccaaagcatttttatgaccctaaaataaaaccctgtactcactaaacagtttctccccattcccttctttccctagctcctgacaaccactaatctgctttctgtatctgtgaacttacctatcctggatattcatagaaatggaataatatgtgacattttatgtctggcttatttcatttagcatattgttttcaagatttatccatgttgctgcatgcatcagtattttactcctttgtatagctgggtaatattccattatatgtatatattacaacttgcttatatattcatctcttgatggacatttaggttgtttccatatcttggctattgagaacagtgctgctatgaacatttgtgtatgagtatttgtttgtacacctattttccattctttcgggtgtgttttaaatgtagctttattttaaagagtcagtgtttgtagatgcagcccgtgtagctgggctaagcttgtaataacttcacaagtgctgtggagaagcccaaattctacccaagagtagaattgttgggtcatatggtagttccacagttaactttttgagcaactactaaactgatttctaagcagctacattcccatcagcaaagtttgagagttccaatttctccatatcctcactaacgctttttattttctgggtttttttttctttcttttaattctagacatcctagtgagtatgatgtggtatctcactggggttttgttttgtatttctttaatgattaataatgctgagcatcttttcacatgcctattggttatttgaatatcttctttagagaaatgtctattcaaatcctttgctcatttttttaattgaatttttttgtctttttgatgttctttatattttctataagagaactttgtaagagttttttaaaaatatattctgggtaatagaaaatatataatttgcaaatattttatccctttctgtaagttatctttttactttctggataatattctttgatgcacactttttattttgatgaagtccaatttaccttttgtttgttttttgtacttttattttcatatctaggaatcgactatcaaaaatgaggccatgaagattaacccctgtgttattcttctaagagttttgtagttttagttctttattaggtttgttgatccatttggggttaatttttatatatggtgtgagacaaaggtccaacttcattcttttgcatgtggatatccagttgtcccagtgccatttattagagaaactattctctcctcattgaatggccttggcccccttgttgaaaatcaattgcccatagatatatgattttattgctggactgtcaattctattcaatttgtctatgtatctatcttaatgccagcatacggtgttctgattattgtaggtttgcagtgttttgaaattgggaagtgtgagtcttctcactgtgttctccttttatgaggttgtgttggttttttttttttttttttttttttttagctattcagggcctttgcaattccatatgaactttagaataggcttttccatttctgcaataaaaggtctttggaagtttgatagggaattcactgaatctatagattactttggggagtattgccatcttaacaattttaaatcttccagttcatgaacacgagatgtcttttcatttatttatgtcttatttaatttctttcaacaacattgtataattttcagtgtacaagacttgtgcctctttggttaaatttattcctagatgttttattcttttggatactattgtaaatggattttttaaaaaaatgtcttcttagattgttcattgctcttgtatagaaacacaattgtttttggtgtgttgatcttgtacattgcaggattgctgattcttttgttagccctagcagttttttgtgtgtgggtttactggcattttctacatacaggatcatgttactagaaaattcagtatttattttgatgcttaaattgtcccagatttggccagtgggacactctttcaaacttgctcctgtgtcccttaggtacatcctcattattctgggtacctccttgctttctagcataatgagatattccatgatgactttgtattctccctgctcaagctccagaattagccctttctctacagagtcatggtttcttttactggaggaggatattgagaaaccaaggtttgaatggtagatatggtcattgctattggggtgttcccatggcctctccatgaatagaactagggaatatatgtatgtatactatacatgtgtatatatatattatatatataatatatatacacaaattcatatctatatttattttttctatttatatatattgtttacatttatatatattgataaccatcagtttacactaataactctatcccaataccatagggatcattctagttttttctttttccacagttttgcttatctcagacagtgagaaaccttgcttctattttttttttttttttgacagagcgtctcactctgtcacccaagctggagtgcagtggcatgatcatggctgactgaagcctcaacctcctggcctcctgggtttgagtgattctcacgactcatcctcctgagtagctgggactataggtgtgcgtcatcatgtccggcttattttttattttactttttgtgagacagtgtcttcctatgttgctcaggctggtcttgaagtcctggcctcaagtgatcctcccaccttggcctcccaaagtgctgggattacaggtatgagccactgtgccaggccccatcattcttaatgtatttacttatttgataaatcatcctgcatgcagtaatttctcattgttgcctcaacccccttactgggaaagtatgcttcttgccctacttggactgtgaactccgtgccaggctgttgtcactgcctgccatgtggattccttctaatcccacttatggccccacagaccttcccagcctgtcccaccatgtggctcaagttctgacacccttcattaggctacctcttgcttggctgtccctccacaggtcaccctcttcacccaatttttgctctgttaccccttactaggccacacatatgtgtggatgcccccctcatcttgttttgattctagcatctttctgtaggctggtaaaggagccatactatatacatatttagcacaggcaaatttaactataaacacttataccagaaaggaggagaaaagaggaagaggaaagaaagaggtgaggagggagaggaaaagagaaggaaaggaggagaaaaagatgtagaaggagagaaagagggaagagagagagagagagagacaaagagaaacaccactaagacagtgcagttgattttactcacctttgcacttaatgggtatatgcccttgactgaacattaaattattacagtactcttattaggtagccactatgtgccccaatttatatatgtgtcaattgaggcttaaagaggttaagtgttgcctcagttcacaaagctagtatgtgtgacagaacggggattctaaactgtctggctgactcaagagctacgcgttcctgtgtccagggacgtgaaacccatttcctgctgtggcagcccattccagccttgcattaccttgactatcagaatgttttgtccttttttacaattgaaaatctgtctccctgaagtttttccacccattggtgttggtttcaccccttggggatatataaaacaattctgattgctcttccacatgacagcccttaaaatatttgtggacagctctcatatcccctgagttttctgttctctaggctaggcatttttagttcctacaactattcctcttatgagtgggaaaatgtctttcttctagcttgttatactgcactaatcttctacggtaagaaggattcagttcatgccccaaacataccctattatattcaggacaaaaggagagtctgacatttgcttttcaattgaagtggcaaatatggaattcaacctgccttcccctgcagacgtttattagtatatgagacataagtgccacatcctctttttcacataagcctttctgtacataaggttaaaccattggtatagaccccattttttttttttttaggaaagttcaagaattttcatggactattactcccatccatatgtcattaggaatatgtagtattacaactagctcagtacatttcataattacctggagctcatatgtctgatctagcatccagaatatatacaaaactcctacaacttgacaacaaaaaagacaaacaactcaaaaaaatggaaaagggagttgaatagatatttctacaaaggagatatacaagtaaccaacaagcacacgaaaagatgctcaacatcattagtcattagggaaattcatatcaaaaccacaaggggctacaacttcacacccactagaatggctagaatttttaaaaaataaacagaaaataacaagtgttagtgaggatgtggagaaactgtgtaatattgtatcatgcttctctggtaggaatacaaaatggtacagctactatggaaaacagtttgcttcttgctctaaaagttaaatgtagaactactatatgacccagcaattccactcctaggtatacacctcaaagaactgaaaataggtggtcaaacaaaaacttgtatacaaacgctcatagcaacactgttctcaatggccaaaaggtggaaacaacccaaattttcatcaacagatgtagggataaaaaagttgtggtatatacacaaatggaatattattcagccataaaaaatgaagtacagtggccgggtgtggtggctcacgtctgtaatcccagcaatttgggaggccgaggcaggcagatcacgaggtcaggagattgagaccatcctggctaacacggtgaaaccctgtctctactaaaaacacaaaaaattagccgggtgtggtggtgagtgcctgtagtcccagctactcgggaggctgaggcaggagaatggcgtgaacccaggaggcggagcttgcagtgagccaagatggcgccactgcactccagcctaggcgacagagtgagactccgtatcaaaaaaaaaaaaaaaaaaatgaagtactgttacatgctgtagcatgtgtgaaccttgaaaacattaagtgcttaaagaagcctgacacaaaagaccacatgttgtatgatccatttgtatgaaatatcctgaataggtaaattcatagagacagaaagcaaagtggttgctatgggctgaaaggaagggagaatatggaataattgcctaaagtgtatggggtctcctttgcaagggatgaaaatgttttggaactggatagaagtgatgattgcttaacattataaatgtacttaatgcaacttaattttacactttaaaaaggtcagttttatgtcatgtgaattctacctcaataaaattacctggagctctctggaaggtgagaggatggtggggagggcaaacaaaatgttttcctttatttctgtcattcaaggttgagttacttgtttcaaaagatgttttaaagaaatgaatgaagctgaagctgaaaaaaaaaatcatgctagcttaaaccatggcaactgtacattatctgagttagggcacgtgttttctagccagattattctaaaaaccatgctaattaagtaaaataatggcaattataatgaaatgacaaccaacatcgggcttcatggatgagtatacttatcacttaaacatacagttgttaaatcagggcattttttccattacgtactattttggatggtaccaatccttattttctggaagaaatcaattttaactagaaccattgcattttaaatttccatgcagtgtaggaataagttagtattcattaatattttccatacgtactttcacttgcaaggtgttttctttctggattcaacagtctatcagggagctatgaaaaggtatcatcaaagaggcaaaatcccaactgcctccaaaacaggcaaattttacttctgctacacagcccttgagtgtatctcaaatatctttcattgttaatgagccaaattctccaagggcttccacttctccccaggggaaagttagacacgtggagaaactgcatcaacatacaaaccaccagggtgccatttggcaaatttcagcttccatgttctgggaccctagaggagattaatattgtttcccaggctgtcaaagttcttctcacgtgtagttgggaaaatcaattaaagtattgagtaaaatttgcacgtactatttagatatgccgagacaaacatctaaaactagattgccatcctggaaattagtggatgaaataatgttctctgagtgctctggtttgggtacttaactatgttttcatttataaaaaatcagggagaaagttggagggttccgtgaaaattattttaaatattgttcaacatcacctacagcaaagtcagtttttcattcacaaatctcactgtgcatgtttctccagaccttcatcttcctctggttatatagagcacattatgccagtatcctagaaagagggatggcaattaactgcatgggtaatttgctatctaagtcaatcattttgtaaggggtatatgagtaccagaagaacttacagtaactgttaaatcagttagtaaattagcaggataagccattatatcgaaattgattttttctcttcttccttttccttcccttcaattgtctataagtgtattgtttgtaattatacatcactacagactgacaatcattgagtaaccaaaacaattccaccaccatatccatcatctggctcattaccaccacatttcacatatgggagcaatggctacagaaagcactaaataaactggtgttagtctaaagaaaagttacatttactttttaaaagaaaggctaggtttggccgggaacggtggctcacgcctgtaatcccagcactttgggaggccgaggcaggtggatcacttgaacccaggagttcaagaccagcctgggcaacatggcaaaaccctgtttctgctaaaaatacaaaaattagccaggcgtggtggcgcatgcctgtaatctcagctactcaggaggctgaggtgtgagaattgcttgaacccaggaagcggaaatttcagtgagccgagatcacaccactacactccagcctgggcaacagagtgagactctgtctcaaaaaaaaaaataataataataaaaatgtttattttaagaaaaaatatacagctgagaataatgcattttctcatgctctttgctttgaagtttgatcctcaaatatttttgtttgctggagtgtttttctttttttcctttctttttttttttttttttttccagagatggagtcttgctttgttgcctaggctggagtgcagtggcccgatctgggctcactgcaagcttcgcctcccaggttcacgccattctcctgcctcagcctcctgagtagctgggactacaggcacccgccatcacgcctggctaatttttttttttttttttcgtatttttagtagagacgaggtttcactgttttagccaggatggtctcgatctcctgacctcatgatccacccgccttggcctctcaaagtgctgggattacaggcgtgagccaccacacccggcccgcttgtgtgtttttcaataactctgatatgacttgtagaatggcatcaagaaaactctgttactacagatgttgaggttattcttcctattctagttaccattgctaaggaacaaaccacttcaaaatgtaaaggttgaaaccagcagtcattttatcacctctcctggtttctgtgggtcaggaagttggggagggttcatctgggaggttctggcttggagtccccctgcagtcccagtcaaacagtggctggggctggagagttgtgagctggagcagaaggggcttgcaaggcatctctctctgttcatgcaattttggcacttctccatgtggtctcttcacacaggctaatttggacttcctcagaatgtggcagactcagggctgtctgaaaccttcaaggatgattattccagcaaacaaggcagacactctgtcacctaagacctagcctcagaagtcttgctgcattatttctacctcattactgattgcaagcaagacacaagcccagacagatttaaggcggggtgggggttggggtggggtggggtgtggggagaggcgggcctgggagggaggggccaactgcatcttgaagagggagtggcaactttctagagagcatgtggggtggaagatattattgcaaccacctttggataatataatttgccgcacctggtttgatcacagcttttctgttattttgctctcctctaagttcctggtcaattgaggtttttccttttggcaatcaaatgcaacatcatgattatgtttttattaggttctgtcatatatatggtgctgtgccagacacttcaggcttgatacaaaaaaaatcatggtctcttccctctgagagattatcttcaaatgaaaagaatgtaaacagataagtaatacacattttattctcccctttttggtcaaataaaagaaaatggaaagagtaataaaataaacttattacattctcaaaataacaccccaaaagacccttccctttaagaaagagactataaatgcattttatgttactagatacttcacttaggaattctttgtttgaaagtaatggaatagtaactcaatgtagcttaggaaaaaaaaggagggatcataataagaatagaagagtatctcagaaagcccaaggacagaaacgtttctgggcctcgagaacaacctggaatgagaactcagatgtcatttgagatttctttattgttctctgcagtccagctttcgctgcttcttttatccacgtcataaaaaacacggcaaatttagtgcttaggattccatgtacttgcatagccactagagagaaactattttctttgctatctccatatccaaatgggttcagctgacccatggtttcacaacaaatgtggctaagggctggagtggcagtatgtgactatgacagcttcactgtaatcgtgtagctctaaagaggggtcaaggctcagaaaaggcgtgctgaggaattaatccaataggtgtctactagaccaagattggggaacatacaaagaattgatgccgtgcatagatagaataagaaactgaccacctgatactttttaaaagcttgttaaaggccctatcagatccaaacatctctctcaataatctatcaaaatgtgactctcttctttctcatgttcccatagttattttggaggagaaaatgaagtcagctcaacattttatttttaatcaaatgttttatcctcagatgcactggttgacatattacatatgtcagaccatgaccagaatagtggactcaagtgtcttgacatattggtgtgtcacagtcagttgtgcgatatcacaagccatatgatggagtcaaacattctgaagtttaaaagacctacttcaaaaagaatataaaattacagcagactcaaggatagtcctataataccaccatttctagtttctagtcctatgctttttctttttgttccagagacacccaggctggagtgcacagtcacagctcactgcagcctcaactcctgggctcaggcaattctcccacctcagcctcctgagtagctgagactacaggcgtgcaccaccatgcccagcttagtttttattttttgtagagatggggtctccctacattgtctagcttggtcttgaactcctggcctcaaatgaccctcccacctcagcctctcaaagtgctgggattacaggcatgagccaccatgcctggccaatatgatttcttgagtggacaaaaattacagattgtgcacaaggcattgcataaatgctggcatgttataggagctgggtcatagatgtaatatcatcagaaacatgcattgccatggaaatcaagtttaaaaactcctgcattaagaacctcgaagagcttgagaaaaggtataggacagattaatttcaatttgattgtgggactagggagatgttgtgagagaagctctgggcaggctctgcaaaaggtgtgggtgggaagctatatcctggacaggaaggagagaaccagaacaggtccttggagagaaggctgctaaagtagatatgagggaaggggaaagaaggcagggcatggaagagaatcttcacatatcttataattttgcccaggacaagtcctgtttgtgcaacctcattatcatatacttaacattttttcatcaggacaaactttctgtaatgagattccacctgtctcattaacaagttaatcaaagcattcatgagccatacacagaaacccacaagctcatctcttaacacttggcaatctgtacagcacttgaggaaaaaaagattgaatacacatgccaaggccaatttatctcaaattagcaaccaagaaaataaatgtaagagtaaatggcagaaagggatcatgatagtccatttccgtagggaggtggactaatagacgcccacagatgagctctaagtacctgaataagtattgtgatattttctgtccttcatatttctagtttgctgttttgaccttcaagggaatattcacaatgttaaaatgaaaaggaaaaaaacttgcacatcctcaaattaggtatgctgccaccaggtggttgtagtatggcacagccatgtcgtccaggcaattagcatacagtataaacaggtgtcttagaaagaggattagcacactattcccatattctatttttaaaaagttattacaacgaaaaagctttggttaaatgtataaggagataatttgcttatagattttaagattttgctttgtttcagttttgtctttgtaaagaaatgtatgcttatgtacaatttggtatcagttttactaatctttaattttgtgatatcactttgaattatacgttgtagtcaaaaagccaccctgtaggctgggcctcaacctcctgtaacttacactggatatcaaaatgaccagggtacttatctctcagtgaggggcctactcttttgtctttttgtaggtagccaattcaacttgcctaactggtctgagataagttctttttgacttttcagtttacagaagcccttcttcttttctctaaacctaaccagggaataagttaagaaaagcaccttgctatttagaccaatagtttgtgttctccatgatgttatttgccatatttcatcaataaagtgtattgaagggaacaccatggatttactaacactttctttatggtgtgaaaagtagggagaaatgtactcattcattatatgaaaaatcccaactggagatgccttaaaatgtgcaaaatatatattagttagaattgataaaataaggcagtaatctctctaatagaccatttaattgctttgactaaaactacaagttccttgatttgcacaaaaaggtctctgatttgcttcgcatatcacttctagctatgtagttgagagagtggccagaaagatctttccaaaactgggtttttaaaaggccaatattccatgcttaaaacagaatattctgaattagaaatacattggtagaaaaatttgtattgattataccataatatgtccaactcttacgtttggattatgtgagattaatatcatcatatcatcatcatcatcatcatcattgccatccaccattcagctatttcttgagcaattactactcaccaggctctgtgctaggtgctgcctattgttacaacagaactcaaccaaagatatcctgtcagttattcacaagccctctggcaacaccttcttcatgctgcaaacccacatgcactgtattttcgctatagctttccatgaaagagcagatgttataaagatcacccgaaagtgaatcagaagagtcacagtctttgatgcaacatatagtagcacattcaggactctgtatttggctatgtgaaattgtttggggagaatcaaatctttctggagccttgacttatctgtacttttatcgtgccattttatgtgtcttatctcatataggcaatttaagtaaaatgacccatttacctgatgtggcatttgttacaaaggtcatttcccactgtgccatagtgaaataattagcatgatgatgtgatgtacgtctgttttggtattgttctgaacacagataatttatcccaaagcattgtcttttggcaccaagacatttatctgttcttcaaaggtacttctgcaagagatgatattatgaagataatgaaagtatgtccattactttcagaacgagtcatttagcaagatgacaagtgttgtccaggctttgttgccggagttctctgtcttttgggttctgacagtcagaccacaggaaagtgagcaactttagcatctgttgttgcttcctcctcccaatctaaaacattatttttatatagggaaagaatgcaaattgagaaacactttagttttctataatatcatttatgtacacagggggtttcgacactttttcttacccaggaattacttcctcattgtccaccaccactataagaatgagaaggtagatgttatcatgtcagcttaaaattcacaggcagttttcacaaaagaagaaaatgggttaggcatgcaggaaagaaagggtttcataaactatttgcacaagaaaaataaatgatgtttccaaaagacacaaaagaatgacaggtaagattgccaattcaagatggcagatttaatgaaaaaattagcctctgatttctcctacaacattacaaaaattaaaataaagggataccataaaaggcataagcctccaatggaaagtaaatatgagaggtgagcaggtaatattaataaaattttgggagctggaaagcttatggccaagtaatacgtgattttaaaataaaataaaaaaaaggcctaatcctaaactggcaatgggaaaagagaaacaatttacattggcaaattttatattaagaaacaattaacagcctgggcaacatggtgaaaccccatctctacaaataataataaaaaaaaatcagctggacgtggtagcgcatgcctgtagttccaactactcaggaggctgaggtgggatgatcacctgagcttgggaggtcaaggctgcagtgagccgtgatcgtgccactgcactccagtctgggcaacagagtgagactctgtctcaacacagacaaactgaaaaacaattagatctaacaaatatcctcttcttctgaatgcattggagaaccagccttcctacaccttgacagaagattgtgaatttattttctgcagaaggtaaaatagaggttctgggaagggaatgccagtcacagtggagggttgggtactatactgaaaacagaagtattaagtcaaaatgtacactgggtactgtaatgaaaacaggagtgttagttgaatcttgagatccccagccgtctctcccaactcctgtctcagaacaccatcatctaggcaagaaatctgaagtgctttctttggtgaatctaactcacataacaggaaagacctaaaaatactgaaatcagttattccccaaagaaatgactcaaccagagtaccctacaaggaaacatacaagctcagagcttataattggcttttcagtttctcattcttcaatatgagcagacagccaaggatgaccagacaaatgaggaaagtctcaaatatgaatgacagagaccataacaacaaacaagcacatatataaaaatcaaacaaaagtaaccgggtaggaacagactatgcagtgagatatattatatgagaaaatatccatgaaataataacaagttttatacacatacacaaacattcaggaaataaggaaaatatcctagaaattaaaaatatagcagaaatacactcaaaagataaagttttaaagatgagttttaaagataaagttttaaagataaagttattggaaagcaattaggaagtagagcaaaaagaatgatagaaacaaatagaaaattagaggattattacaggaaactcaacattataatattaaggagtttcagaaaaagaggacagagaaaatgtaggaaagaagatcaaaggaataattcaagaaaaatttccactcctacaaggcataaatctccatattgaaaaggcccagggctaaagcacatcactatgaaatttcaggatatctgggaccaagaagagatactacaaacattcaggaggatgaaccagactcagaatggcataaaactcaattgcaatatgggaagctagaagctgatggcacaaactttcaaaatgttaagagaaaattattatcgacctagaatgctatacccagccaaactattaatcaattatgagggcaaaataaacaaactttcagatttgagaaatttcaaaacattttcccctctccccaagcaccctttttcagaaaataactagggcatatcttccacccaaatagaggtgtaaaccaagaaagcggaaggcttgtaataaaagtcacatgggatccagcttagaacagggacaaagggaatccccagaatgatttcttacatgggaaagaataggtacatagaaagctaagggaacaaataaagacaactattaactatccatgtcggtttaatcaaaataatataattatataattataaggtaaggatgggaagacaggaaaggaatatgtgtatatatttgtatatagttggagacaatataagttaataagtcttgttttcaatagtggaatagtgattgattatttctaaagccaaaaaatagcaaagtaacaatgtaatcatattgtttagacctgcattgctaaatacaatagtcactgccacatgtggctatgggacacttgacatggggctagtgcaactgagaataagtttttcaatttatttaatttgaactgattaaagtttaaagatcttatactcaattcagttattggaaagcttttaagtgtttggaacaatttatgtatatgaattttttttcaaattatagggaagctacacacagatcaaacatttttgatgaaaattttacatccaaattgagatgtgctgttaatgtaaactgcataccagatttcagaaacttagtatgaaaaaaagatgcaaaagatctcactgactttttatattgaatatatcttgatatgataatatttggggcatacccggttaaatgaaattttttttacctttttgttttgacttttaaaatgttgctactagaacatttacaattcacatatgtggttctcattatatttctagcagacggtgctgatttagactaatagcattacagcattaaatatcaaaagatccactaaaatagatgaaagtcaacttcagggatcaagatatagggcatggaggaggtcaaagggccactgtttgtcatagtactatagaatcatattctatgatataatagaattatttttattgagacaatagttgtacatatttatggggtacatgtgatattttcatatatttagatctgagcaatgcaggtctaaataatatgattacattgttactttgctattttttagttttagatataatcaatcaatatcccactgttgaaaacaagacttattcttttttattgtacccaactgcctacaatgtgtaatgatcaaatcagggtatttaggatatctatcacctcaaacatttatcatttctttgcgtagggaacattttaaatcttccagctattttgaaattagaattattgttatattactatagaactgtgttttattacttgactccttaatcttgtgtatgtacaattttgacaaagaaaaaatacaggattgaaaaaccaatttcttaatattcttttggcttcacaaggctacacctattttcattttcacttggtggtttcctttggaggaagagtaatatcagaaataatgttttcaaaagaaccaagatgccaagaaactccccagtactgatataccatgtgtccaccctgccatctctgtgtgtgcattagctagcaagctgttctttaagcagtattttttcccccataggaatgggttgaggcttaggaatgaaaggtacaaaaacaataaaaattcaattttctgaaggattcaagctgtataaataaacaaaaccccatgacgggttatcattaaggtatgaaacctcctttattacctcctccaacttacccactctctacaattctgttcagggaaaccatagcatattttaaaaaatgaactattgttactaatcaaaaaagcagatagcaaccttaaggctctgtcactccagtgagaaataaggttgggtttatgatgtttctggtcagtttcagtactgtagtaattagaaatgattttctggatttttcttcagtcttactaagcaggaggactcccaagagagaaaggtgacaatttgcagttcagctaacaggcacgacaatgcatttgaaatagcagtctcctagagaattgtcaggagagactgaaaaaaaattcatgtgggaaaatggaggaaagcattaaaaaaaaaaacaaaaaacaactcttctcttcactctcctcttcttgccaactccagtgttccattcaaaagcattgttataataaagagaaaaggcttatccttatcatttttttgtgtgtgtatttgcatttgaaatagatttttatctaaaacccatttacatttctgtaatcactttaatagttgacctgtatacattcagaataattttaatacttaagagggacaagaaaaacttagaggtcccaaaggagaaacaaggaaatgactaaaaagtaaaaacaataaagcctattcaggctagcgaaaaagatgacagagggccaagtgaatactggctttcaaagaaacaatcggcttaggattagtgcaaatgaaggacagaggatctatcaaagggagatttctgatcagtgaaggtcattagtgcctggaatactttattacagaggttgtaaaatgtccttctttgatagcctttggcaaaaggataaatatgtattttgtacaggatttcatatagttttgaaaaagttagggaaattaatcatatggcccttttaagatatttttcagccactggagtctctaatcatttactcatttgaaacgacttattgaatatctaccatagaccaaacactgtgctaggctcagaagagacagcagtgaacaagaaagacatccccatacccctgaagcttattaaatgcttccttcaccattgaatgcgaatttaaagtccagctttatgaaggagctgggctgagtaatagccaatattccttcagtttgaaaattcaagataaattggcaaggtcatttttcatcaatggcagagggggcagcaaaacccagaaaaagccagttctgaggttaaacaacaagctagattttattaattgtaatttcttaatttcttgaggtctttttccaaaaaaagtctatgctgggaaattttttcaggtatgacatttagaaatctatatgtcaaatgataagccaggatcttatcatttcaaaacatttaacaatcatgagtttatcccccgaacatggaagtatgtagcccttggaagctaccgacaagtatttctcaaaatcatctggtcattggtgaaacacctgcttaaaacaaacttcttgtagttaagacatatgcaaatttcatcctgggaactacattgctcttcaacctccagcttctgagaaagaaagcaaagagattttacttaaaacagttctttaggaaggatgaaggcagccagagttgataacaatcagctcaagtaagtctgaacaaacaaagcagtatgggacctattcagaagtcagacagacctccatgatatccatctcttctagaagtatagttttccaaagtttcaggccacctttactctccgctctgataaagataattctcacctttttttcttgtccctaaatgataacaggaagtgagataactgctgaacatgccagccactggaggtctttaggaggcctgaatttcttacattccagacggaggcattatgatacaagaaagatggggttgtccctcagagttatcctcttccagggaatgctcactcagtataaactattgtttgggtaaacagattgtattctcttcgtatccttttttcttttgagacagagtcttgctctgttgcccaggctggagtgcattggcgtgatattgggtcactgaagtctctgcctcccgggttcaagcaattctcctgcctgagcctcccgagtagttgggactataggcgcatgccaccacaccaagctaatttttgtatttttaggagagacaggatttcaccatgttggccaggttggtctcgaactcctgagctcagtcaggtgatctacctgcctcggcctcctaaagtgctggcattacaggcgtgatccaccacacctggccttttcttcttatcctcttcatataccatgttcaaaaaagtaataaaattcagttaggaataacggtcataggtttgcctccttcccacatagaatgagaaactgtacagagaaaccattttactaagcgcattcatggacggggctgggaatccccaccttcttggcgtacaaggcactatagtgtagtgggtaaaagtgttttagctcaggagtcaatttcctgggttcaaatctcaactctgctcttacaattgtgttgcttgggacaagtgacttaatcctctggtgtcttcatttcctcttttcttttctttttttttcttgagatggagcctcgctctgttacccaggctggagtgcagtggcacaatctcggctcactgcaacctccacctcctgggttcaagcaattctcctgcctcagcctccagagtagctgggattacaggcgcacactgccacacccggttaattttttgtatttttagtggagacgcagtttcaccgtgttggtcaggctggtttcaaactcctgacctcaagtgatccgcccgcctcggcctcccaaagtgctgggattacggacgtgagccaccatgcctggctcatttcctcctttctaaagcaaagataatatgggctgaactgtgtaaccccccaacccaaactaatatgttgaagttctaacacacagtacctcagaatgtaaacctatttagcgataaagtctttaaagagataattaaattaaaattaggccattagggtggggccctcatctaatatgactgttgcccttatgagaggaagaaaccttgagcggggatgggaagggtatgatggcacagaggaaagtgcatgtgaagtggcagcaagagagtggccatttgcaagccatggattgaagcatcagaggaaaccatctctgctgataccttgaacgtggactttcagtctccagaactgtgagtaaataaatttctgttgtttaagccacctagtctgtggtattttatgacagccttagcaactaatacacagcacttatccttgtaagactgctgtgtgaattaaattagttaattcatgtaaaatgcctgaaatgtaggctggcacatagttaacactgtatgttcatcaatggaacaacaaaaagggactatctttgctgtatgcagtttaatttaaggccagcagctcattggtccctgaccttacttgggactgggggtcagacctcttcctgttctttttgctaaagacctgaataaaagtagacacagattcttccttgaagggaattccagattctaggccacctgataggaatgttgtaactggctttttggtgggcacaggaggacatgttcagccttcccctctggaacatcatttcactaagaagtttgctttttttaccctatggctgtgaatcattcctatgaacattggtttaactttattatgcaccatcacagcctatcagtttgtaataacacaagttttatagattctatatatcagacactgttgagtataaaaacataatgattttagcacatgtgaattaattttttctaactctagtagattaaaaacgcactgggctaagcaaaaaataggttagagtttcacaggagagtattcgttttaatgaacgaatttgcttattattcaggatcaagtgatggtgcatactttcaactaacctaaagaagttgctttatatctactgcatttagtattactgatcccctataatgatactttctttctagagaccattaaaatgattgtttcatacctcttagaagtctgacaatgggatggcaagtcctattctgattcgatgagcatgaaatggttgcctatcctcaaatgttcctggttttcagcctgccaaagtgtctcgaggatagcactgctaatagaaccctctatttaattgcaaatagataatctgggtttcaaagcacttaatgatcatgaggtgactcattatcacctcaactctctaaacatcaatttccttaactaaaaaatagacatgataatccccaccttgcacaatttaatggcttgtttacaaaggacaaagtgcagctaagccttgaacaatgcaggagttggggtgccaaccccggcacagcaaaaaatttacaagtaacttttgactcccccaaaacttagctacaaatagcctatagttgactggaagtcataccagtaatgcaaacagtcaattaacacatattttgtatgttatatgtatcatatactgtattcttacaataaaataagctagaaaaaaagaaaacgttattaagaagatcataaggaagaggaaatacatgtacagtactgaactgtgcttatcaatatcataaatttacatcacctgtttacaaaatgaattgtccctctgaaatggcgggcaaccacaaatgcagatctcaatctatggtacatatcaagcaattcaactgtttcttgtagtggcatgacttttctctgcttcttgggaccactttgtatgggtcccatgttgttattcaaggattatagtattgccctaaacatgatgaaaaatacgcaagaactgagagagatcacttcttacagtgatacacaatttactggagagacaactgctcatgcagagatgactagcatctcatggccttttaggcagatactcgcaacacttgagctcatcgcaatagcaacaggagggggctagaaattattacagtagtacagtatatagagttaatgttaaatagtcatgatttaatactgcatctatacatttgtttacatttctcttaactgcaaatgatgccatatatgatctgtttgtgtgcatatattttaaaacatattttaaatctattttttataatagatttgtgtatattttatagtagtagatgataaaatacatgagtatctacattatattttatgcattcgtgatgtacattttccttaattttttttgatattgatatggacaggagacagggaaatactgggtagaagagggtggttccctgtcaaaggcactaccctcaagcctggatacccgtggcctaagtgagaactggcattcctgtttttgtgcccaaaaagttaccttttgacccatcacgccccctatcctgtaccgatataaactttgaaccccaggctccagaagcagacgaggggaagaggagagaagcagacaaatggcagaccagtgaggcagagaacaagacggggacagtcagagaatcagccactgtacggccaaactccagggcaatatcatcttcccactccatcccttgtctagctccccatccatcctgctgagagccacctccatcattcaataaacccccccacattcatccttctagtctgtgtgtgatctgattcttccaggatgctggacaagagcctggggtacagaaagctgtcatgtttaccccctgcccttgcaaaaggcagagcccactggttaatccttaagccatctgcaggcagcaaggctaaaagagtgcactgtaacatgcacccacttgggctttaggagtggcagacacccatccctagatgctgctgtggggctgcagtccaaaaatgctcgtcctggttcctgtacctgcccatctgtgtgcttcccatcccataaggggtttgagcttgcggtggctgaacagagaaccacacccctgtcacacatcctgcaagcagagccagggaactctcccatttcaatatttctgggttatgcatttggtctgcaagttttttcaaattgtcacaaatcttcaaaaatttttccaatatatattttgaaacaaaattctgtatgagtgaacccatacagttcaagcctgtgttgttcaagggtcaactgtataatcatagataaccacacactattctttgctgagcacttatgtattaaactttgtgaataattctctgcatgcattacctcatttaaattctcaaaatgacaccatgaggtagatatcattattatactattacatataatccacattttacttaggaataaacaaatgcataagttgactaacttgcccaaggttcacataactagtgaatggcactgcaccaagactagaattcaattcttagctcaagggccatcatctcaaagagacttttcttgactcctctttgtctatttgagttgatatagtggaataacagagactgggtaattaataaagcacagaaatttatttcttacagttctggaggctgggaagcccaaaattaaggtgccagcagatttagtgtctggtaagggcttgctctctgcttccaagatggtgccatgtttctgcaacctctggaggggataaatgctgtgtcttcacgtggcagaagggacagaaagacaaaaaagggccagacagctctctgaagccacttttatatggacattaatcccattcatgaggctggagccctcaggatttaatcacttctcaaaaagccctgcctcttaataccaccacaatgagaattaaatttcaatatgaatttcagaaagacacagacattaaaaccatagcatcccctaaactaaagttgtcattctctgtcatatcactcatcattttgtcttattttctttttaacactcatcattatcaaaattagtattcatttggtttcttgtttgcctccccttccccagtagaatgtaagctccatgagagcagggagctagcctgtgttgtttaccctaaagtctagaacagtgtctggcacataatgggatagaatatttgttgaatgaattgatacttgtctgaacacaaagcttcttggtaaactggaaaattctgtcccttctgctatgtgaagacacagcattcatcccctccagaggatgcagcaacatggcaccaccttggaagcagaaagcaagcccttaccagacactaaatctgctggcaccttaattttggacttcccagcctccaagcctgcaagatattgccatcattgcctgatcttggtttgttaatcatagtgagctgggcctgggaaagcccagggaatgttttaactgaggaaaggggtttgatacacttccctagtgggtaacccaagtaggattttgcagtcagggcaagacaactcctaggagaagtgttgaaaataaacattcgactatacttcaattttctgtatgacatgtgcaaagcacccttagagggccctttattctggtgagaaacatgactatgaaagtaatcataacctctgtgaacctcagaaatggcttaattgagaaaaaatacctgccctgtagaaattcacagaatcaacataatcaacatgaagacaaaatgagatgatgcatatgaaagtgctttgcaaaatttaaagttctgtgatacaagtgtaaggtggtattattatgtttatttgatcaacttaaatttccatttcaatggctaacatataatttatttactggaaagtattcccataatcatctggttatggaaactctccaaatgtttccagctctaagtttattgcatcaaacttagagctagaaacattggtctttgcaaaggagcaagtggaagagatttaactgtggtgcagggaacctgggaaaatgaggggtagggtgtgtggataatccaaggtagaaggcagacttacttctcattgtatagttatttgtagtgctagagacttttaaaaattaaccatttatgggcttggctttgcatttacatgacaacagaagagcaaaagacaaatgggactgggcacggtggctcacgcctgtaatcccagcactttgggaggctgaggcaggtgggtcacctgaggtcaggagttcaagaccagcctggccaacatggtgaaaccccgcctctactaaaaatacaaaattagccaggcgtggtggtgcatgcctgtaatcccagctacttgggaggctgaggcaggagaattgcttgaacccgggaggcagaggttgcagtgagccgagatcacgccactgcactctagcctgggcaacaagagcaaaactctgtctcaagaagaaaaaaaaaagtaacaatttacattatatcttaagggaaacaaatgaaacaaagaagcaataagattaattgtgagcagaagcatgatgatagatatctaagccaagaagctttcaaatgaaaggaggtaccaactcttgctctcttttctagtcggattggcctgcttggtatcccctgaatgctccatgctcatttttgccctggtacttattagtagacactttgtagtgcagctgccctgctcataattttcctttctctgaaaatgaccctggatataaagcagtaattcctgtcttctgctcatagttgattggtttaggagtaggtgttaaaattgagaagcactgcctagaaagaagattcatgaaatgcccaagatctctctgtagttaccttggttcctgacctctttgagttggtttttcaagtttcaagaaagattctaataacatttcaacaagcacaaccctctactgctcactatttaagacagctgtaggtgagtgagaatgagatgtagtattttttaagtcccccaggtgatcccaatatgcactcaaggctgagaaccgttactctaccccaatgatacacaaactgtaatgtacatatgacttacataaagatcttataaaaatgcagattctcattcagtaggtctgcggtggggcccaagatgcttcatttccaacaatttcccagatgatgttgattccactgatgtagagatcacatcagagcagcaaagctctgtgtggtttctgttgcttgaaaccaaaagaaccttgattaaatacagtaccttttctcaggttgcaaccctatcttgtaaggctctacccactttatctatttggatcttactcatcattcaagagtcgattataatctcatttcctttatgaagtcttccttaagtcattgcaaccctctctttccttgttgattgcccatggtacatatagcctccattacataataagtcatttaattgtcttggatagagttcacttacaaatgttggtaaatgtacaattatttcctgtgtaaatctcatctcttcccaaggagtccgtgtttatatttcttgaagttttatatatatatgtatgtgtgtgtgtgtgcatatatatatatatatatatatatatattctctaatatatatattaaagattaaaaaaagatttttaaaagtttccagctgtggattcatttctgcatgttgggtacaaataatacctgaaaattaagtgatggccatttcattttacagataattggggaatcttctcttttatgtatgtgtgtgtgtgtgtgtgtgtgtatatatatatatatatatatatatatatatatctttaatctaccatgacctccaatccagtagtgggaacatggcaggtatttaattaatacttgttgaattaaaggcatatggaaaaggaaagtgtgactaccaccattacctaggatatgtaaagctaaaaacaaacaaaaaagtagaagaggtcacaaaacagattgaaagaatgaccttacatggcttatggtcatgggctcaggaggatagatatatttgcagagagttttggctagggtggggttcatggcctagggaaaaaaagtggatctgaaatgcttacacgcaggtcaagcgtgcagagccccactgcctcgtatagcccagatgccttttggcacaggtactaaccagacattcccctggactcggtgggtttgtttcaaaccaaagaaagaaaagaagagaaatgaacactagagctaaaaagctactccagagatcatcttttatccagccttctcattttaaggataaggaagctgaggctcagaacttaccatgttacagatgaacaaatcttttttttttttgagacagagtcttgctctgttgcccaggctggaatgcagtggcacaatctcgactcactgcaacctccacccctgggtttaagcaattctcttgcctcagcctcccaagtactgggcttataggtgtgttccaccacaactgcctaatttttgtaattttagtagagacagggttttgtcatgttggccaggctggtcttgaactcctgacctcaggtgatccacctgcctcggcctcccagtgttgggattacaggcgttagccactgtgccaggccaagatgaacaaatcttggcccagaacgcaggtctctaattagtaggacaatgttgctccatgcaataatggaacttgtgagaatttttaatcttcatagaaatccccagtctcatagtatcttttgttacttttgtcagggctgggggattctgatatcttaatgaaagagctgtgaaatggcagaggtagtcaggccttgcaatatgtggggaagagagtgcagcatgaatgaatgtagcttgctgaatactgccttctttttttttttttcactacaaaataatttattcgaacacacagctacagtgggagactcctgtgtacaagcacattgacgctgctgaccaccctcaactaggggacccttttcttcccccttgctgtgccttcttaactccagtcctctttttagtctcagtgagccccgttaccttaaatggattcaattgaacataattcccttgctaggcactcattttggtatgagtagagtatagattttctcaagtatgaaagattgaaaaaatgaaaaattaaatgagaaaattcctcttgaatgatgaggcctctccttctggagaccaccagtccttcaccactctctttctagtgtgctgctgagtgggttgaccaactaatatggggtcctaatgccttcatgctacttcatgattcaaagtaatctcagagcaactgggtccacttccttgtgatgcagatatacaaagcccttttagaaagtctatgtattgttaagagaaagcagaagggaaaaaaaagtttccagctgtggattcaaattcatttctcatgttgggtagaaaaaatacctgaaaattgagttggccattttgtttcagagagaattggggaatcttctttttgaagctttactgtattctgctttagcagaaaaaataaaaggatgagaaattgagcagaaggactcaaagagaaataaaattttgatttttcaaatagacacgggccaaagataaaaggccaactagctttcttttcctatacttcagtttgtcttgttctcatattaacccatgtattgttgtgtttagcttaaccccacaataagtagcaccaatgtttaccaacaaatcaatactttttgtggaaaaacaagagtcattagggtgagctagaataagggtggtagctgattcaatttccctaaaaatctgactcagtttctttattttaaaaaaagacagggaaaaaagatttcgtgtgtgctagtgtgaacaattttgctatagtgtaccactacttagaaaagatggcaactcaatgtttaaaacccaaataaatgttatagtctgcctttataaaacacaaccaaagaaaaataaacaaaaacacttgctgtcctctagaatagttatttatgtagtaaacacacttttgccacaacagggcacattagagaataattaaactcactgggtcatctccattttgaagccaccttgatttaacactgcacagggaagtaattagatgaatttgaaaccatagtcttaggggagaaaaatagcccagaatgtattccaaggagggattgtaggcagcctcagctaccattattatacagaagattgtaaaaaataaaagtggagaacaggttgtagagtactttgtactcagtagcttccagcctggctttttagcgtctaatgtctatgcttgcaagttctgggaattctctaccctcagaatcgggaagtgcttttcagagagccaaattctaagtttccacagctgaatctctaagagagattgtaaacctggcttgatagggcattgattttaatcttttttttttttattacctttcccttcagtatcccctatgtccacactcctaactcaagtttagaatgtgtaagtggaaggataaaataagtggaaagttcacatttggaaataagcaaaactctaaatgtgtggggatagtaacagtacagtggttaagagttcaggtcctgaattcaaatagacctgggtttgtgtccctgatctactgtgtgccacttggatttatctcctacttcagctccccatttagctcctctctaagtgtcatggagagcagggggtagggtataagtaaatactaaaatcacctttttactaaaaactctaacatattggcacagaacatgacattcctagcttaagcaggtgggaacaagaagcagagatataggccattgccattaagtgacctcgtatgtacttgtagtatctgagacatgggaaaatttgaatatgggaaacttttctttctagctttctctcctccttgagggcaggggctatgtcaaatcaccctttataggcttggtagtgccttgctacagtgcctggcattcaacaagggaatgaatgaagcacagtgtatgcggcagaaagacatgatttcccaggagacagaattgggctgtgttccctgtgttctccaagacataataactgaggagtgtggggcggagtgccgctgtggaaatactacaggggtcaaagcaggttgaacccggagacaaaaatgcagttgcacgtggcactgcctattaacatacgtgctcatgattaaagtaaacatgggacaaagttcaatatgtcctagggaacatgagaaaaaaacatgcaccttctcagggagccactgtcaccttgggttctctggagcattctttttttttttttttttcatttgccccactcttccctcctggtcaattttcctcaagcctctggaaggcatttctatttgtaccgcttctttggcatgaggagaatggcttggtgacctgtggatctctccctgacccagagcctctggactcctctgaggaggataattatgtttcaatgggcaggtgctgaagcaatgttggcatgccaagattgaatcagcaagaacagctatcaaggatgggactgtgcaggaaaagcaggatttttttttatggttctatgcacctgctagctgccacttattcacctgctcattggtgtgttggctggattttttttttttttttaatgagactttccctaggtgtatttggcaaatgatgtgttgaagctatttattctctgcctcccatggaccctcaggctcacctcaaatcatccaggccttggctgttttccccttatttcttatttcttgccacctggtgtcctgtcaggccaatttttggctgcattggtttttgtctgctgagttgtgcttggcagaattacctctcccagaacagctatgcactagagatagttacatggccatttgggcaatgggctgtaggggccatagcttggtcctgagtggaatgcacaggcagtgagggcacaaagctcaagtgctgcagtgtatggctgggacagtcttcggcattggcaggcctgcaaaagtggccccccaactccatcccccataccctacacacaggctatgtcatgtacaggttgggaatgtgggttctggtatcagactatttgacctcaaattctaattctgcctcttattaactcaatgaccttgaatgagtcacttgacatcccccagcctgagtttccctgttgaaaatatggaaggaaaatataagagtgactaccccctagactgttgtgggcattacactggataatccacgtaaagcacttggcagagtgcctggcaaataagaagtgctctacaaatgtcaacccttattttaaaattcatggaagtgtatttagactttggggatttcatttctgcttcaaatttgtgcttccccagttggttttcttggcacaggtctctggggaatggagcattttaggcagagatatgggagaagtgaggcaaaactactggaacctactctgaggcctgaagtaaaaccttccaagctggaggcgtaacgctgggggattaggctgcttacaagctaggaaatgatggtctctgggctctgccagaatctcctttaggcagagtactctgttctgcctaaggcctcccctggctgttaaagcatctgcttagactgtatttgtttgtataactgccagatcctggggcactcagatgcttatgttcatcttgaagctgttttagtatttactagcttaaaaaaaatccttggaatttaaatatgaaaaccagcagtaaaacaagggtaatgatccaaaatcaggcatgcaaaatcaggaagcatcaaacttataactatgtaccaaaacaaatatttataagttaaggtagcaatagaaaatgctacagaatgagccaattaatgttgccatggttaacaaattgtaattttgacatatctctaggatagctttatcagtaatatcagtattatgcttttaaatgttgagttttatgggtaatgggttaatgtatcattacttcctttcttggggtaaatcagaagctctcccttactttggtcattgtttcggaaaaacttactaagaatggatgttatgagtaggatgaataaattaatgcctttacagtataaagctttacttttggccaggagcggtggctcacggctgtaatcccagaactttgggaggccaaggcgggtggatcacaaggtcaagagattgagaccatcctggccaacattgcaaaaccctgtttctactaaaaatacaaaaattagccaggcgtggtggcgggtgcctgtaatcccagctacttgggagacagaggcaggcgaatctcttgaacctgggaggcagaggttgcagtgagccgagatcataccactgcactccagcctggcaacagagtgagactccatctcaaaaaaaaaaaaaaaaaaaaatctttactttcagtactcaatgatctataagtttttgggattcaaagatcttttctggatctccttatttatttatttttggtacagggtcttgctctgttgcccaggctgaagtgcagtagcaagatcctatggtaactcactgcaaccttgaactcctgggctccagtgatcctcctgcatcaaccatctgagtagtggggactgcaggctgtgtgccaccatgcctagctaattttctaattttttgtagagatagggtcttgctttgtttcctgggcttgtcttaaactcctggcctcaagcaatcctcctgccctggccttccaaagtgctgagatttcaggcatgagccactgagtccaacccagatctctttcagatacctaagaaaccctagagaatgttttgcaatttgccaaggagtatggaaaaaaagagctcatcattttggcacctgctttaatggcagaggtgacactgatgaatccctaagctgcataggtctttgagatggaggcaggttctaaggtagaatggcctgatgaacagtgagcagaccgttggtatgccaaacctagagccttcttaggaagtcctgagtggctccagatggctcccaggaggtcatgttattttcaggatctcagataatgcaattactatcattggaaagaaatgttcaagaatgttagacatctagagataatcagaatttattgaaatggatttagaaattaaacaacatgttcctagatggtacataacagagaggccttggcccttgaatcttataggccttgggcccactgtttatccaacctgccctcagaaagtaggctaaactcagggaatatccacctctatcatcagtcattatgtctgtgctgatctccagtggttgctacatagcctttagccaagacctgtttagaatcaccccatttacaagaaggtaatctcaagttttactatcactttaactctaaattttgaccttagggttaccccagaaacttcagagaagccatgagttttaaatatcatccggtctaaatctttttattttatagatggagaaatgcagcaaagaggagagtgatttgctcacggtcacatagctagaacacagaagggccttcactagaatccaggtaccctaactccctatttaatattctctgaagtccccttaaaaataaggttttgcagcctcaccagcccagactgttgctttgattgtatgcaaacaaagcatggcttttttttttttaatttttttaattttaattttttttttcttttgagacagagtctcgctctgtcgcccaggctggagtgcagtggcgcgatcttggctcactgcaagctctgcctcctgggttcacgccattctcctgcctcagcctcccgagtagctgggattacaggcaaatccaccacacgcggctaattttttgtatttttagtagagatggggtttcatcgtgttagccaggatggtctcgatctcctgaccttgtgatccgcccacctcggcctcccagaaagcatgttttaatggttttgaggaattatagagagtactaaacacattttaggatggaaatgaagtctagagtattttgataaagtcgccactttgtttttccactaaggatttgcctctgcaactctctcaaggagttaaaattctctacagttgtcagtaattgtgtgtgtgcataaataggcagtacaattcaatagaggagttaaatatgtgattaagagatatcttgcaatcagtgggaaactgttgtagcttagcacaaagaaggccgttttttgttgttgttgggagagacttgttttcttttagtcttttgatgctttattaattgtgataaggatggttaaaaatgatattttcctcataggaatagcatagtcttagaaaatttcagcttgctcaacactcaaagagtttaagaatattatgtatgacattgagatccacattttgttcttatcctaaccttgacatgagttctgagtctagtaatttcttgttcactgtgatgttaccaaaatatgactctagaaaaatttcaaaaactatatgccttgtgaaaaaaaggaaagctaatagaaagtaggcccttagaaaatgaggcaattattaagccaggcatggcagagcatggttctcttacccaagtctaggacttgtaaaaacacagatggccgggcatggtgactcacatctgcaatcccagcattttgggaggccgaggcgggtagatctcctgaggtcaggagtttgagaccagcctggccaatatggtgaaaccccatctctactaaaaatacaaaaattagctgggtgtggtggcaggtgcctgtaatcccagctacgtgggaggctgaggcaggagaatcacttgaactagggaggtggaggttgcagtgagtcgagatggtgccgttgcactttagcctaggtgacaagagcgagacttcattgccggaaaaaaacaaaacagaacaaaaaaaccaaacacaggttactgggcccctccctgagagcttcttttttttttttttttaattttcttaaacatcatttatttattcattttaatccacaaataaaaattgtttatatttatcatgaacaacatgttttgaaatatgtatacattgtggaatggctaaattgagctaattaacatacgcattacttcacatacttatcacttttttgtcacttaaaatcttctctctgatcaattttcaagtatactatacattgttattaactatagtcaccacattgtacaaaagatttcttgaactatttctccaatctaactgaaattttgtatcctttaacaaacatctctcccgccttccactcaaagctctagtaaccactactttgatgaattcaacttttttagattctacatataggtgagatcacgcagtatttgtctttctttgctttacttatgtcacttaacacagtgccctccaggttcatccatgttgttgcaaatgacagaactttctttttttaaggctgaatggtactccattttgtatctataccacattttctttatccatctgttgataaacacttaggttgatttcatatttttactattgtgaatagtgctgcaataaacatgagaatgcagatatctcgttgacatactgatttcatttcctttggatttatacccagtagtgggattgctggatcacatatagtagttctagttttagtttttttgcagaattttcatactgttctccataatggctgtactaattttcattcccatcaatagtgtagaagggtttcccttgcttcatatcctttccagcatttatctttcatctttttgataaaagtcatttaacagaataggtgagatgatatctcattgtggttttaattttcatttctctaagaaatacaaggcatccaagtaggaaaagaagaagtcaagctctttctcttcacagatgatatgatcctatccctagaaaaccctaaagactctgccaaaaggctcctggaactgataaatgacttcagtaaagtttaagatacaaaatcaatgtacaaaaatcagtagcacttctacacaatagtaaggttcaagctgagagccaaatcaagaatgcaatcccatttacaatagccacacacacacacacacacacaaaaaaaaaaaaaatacctagaaatacatctaaccaaggaggtgaaagatctttacaaggagaactacaaaacactgctaaaagaaatcacagatgacacaaacaaatggaaaaacattccatgctcatgtaaactactgtcattttaaacagaagtagaaaaatcttttttttttttgtcagagtcttgctctgtcaggcctaggctggagtgcagtggcgtgatctctgctcactgcaacctctgcctcctgggttcaagcaattctcccgcctcagtctcccaagtagctgggattacaggcgcccgccaccatgcgtggctaattttctgtatttttttagtagagacaggtttttaccatattggtcaggtcttgaactcccgacctcaggtgatctgcccaccttggcctcccaaagtgctgagattacaggcatgagccactgtgcctggcaaaaaaaaaaaaaaaaaattaaatttcacatgtaaccaaaaaaagggcccaaatagccaaagcaatcataagtaaaaagaacaaagctggaggcatcaatcacattacccaactcaaactatactataaggctacagtaaccaaaagagcatggtactggtacaaaaacagacacatagaccaatggagcagaatagagagcccagaaataaagccatgaacctacagtcatctgctctttgacaaattgaaaaaaaaaaaggaatggggaaaggactccctattcaataaatgatgctgggatatctggttagccatatgcagaataaaactgaacccctacttttcaccatatacaaaaatgatctcaagatgtattacagatttaaatgtaagacctcaaactataagaatcctagaaaaacacctaggaaacaccactctggacttgataaagaatttataactaagtcctcaaaagtaattgcaacaaaaccaaagattgacaagtggtacctaattaaactaaagatcctctacgtagcaaaagaaactatcaacagagtaaatagacaacctacagaataggagaaaatatttgtaaactatgcatctgatgagggtctaatatctagaatctataagaaacttgaacaattcaaaaagcaaaaaacaaataaccctattaaaaaatgagcaaaggacatgaacagacacttctcaagagaaggcatacaagcagccaacaaactaatgaagaaatgctccacatcactactcatcagagaaattcaaatccaaaccataatgagataccatttcacaccagtcagcatggctgttattaaaaagttaaaaaacaacagatgctggcgaggctgcagagaaaagggaatgcttatacactgctggtgggaatgtaaattagttcagcccctgtggaaagcagtttggagatttctcaaagaacttaaaacagagctatcagtcaacccagcaaccccattactgggtatatacccaaaggaaaatacattattctatcgaaaagacacatgcactcatctgttcattgcagcactattcacaatagcaaagacatggaatcaacctaggtgtccatcaatggtggattggagaacgaaaatatggtgcatatacaccatggaatactacacagctataaaaatataaaagcctgttctttgcagtaacatggatgcagctggaggtcattatcctaagcaaatgaatgcaggaacagaaaaccaaatactgcatgttctcacttataagtggtataagtgggagctaaacattggatactgatggacataaagatgagaacaatagacactggggactactagaaataggaaggagggaggagggcaagggttgaaaaacaattgggtaccatgttcagtacctgggtgacaggatcattcataccctaaatcttagcatcacacactacacccaggtaacaaacctgtatatgtatcccctaaatctaaaatagaagttgaaaaaaattttcatttctctggtgattagtgatgttgaacattttttcatatacctgttgggcatttgtatgacttcttttgagaaatatctcttcaaatccttttccattttttaattgggttgttttcttattattaatgcagtttcagatctaacaagttcccaggtgacgctgatgctgctggtccaaagaccacactttgagaaccactaatgtagttcattcaaaaaaaaaaaaaaagtaaagagtacttactatttacagagtaccttgagaatcgcactgtgctgagagagctgatggaggtacatggtccaaagtcaaagcaacaggatccctgtgtgccatgaacacgggcccatgacctagaccatgaactgaagtagtgagttatgagcagggatcacattttgaggacctctggtatagagagtgcagaggcaaagtgttcctcagacataggtaagggaccagatgactgcaatacagtgtaataataaggtgatgctttgggtatatactttaggcagagactttcatgccatcatactttcatgatattataaagatagtatgaaagaaatagctaatattttgagtactttctttttatcatagtatatatcttgatagtatgttaagtattttacatggataaacccatccactcctcacagcaatcctgaggtaggcactattattatcgttattttacagatgaagagactgagacccagaaaagttaagtgacttgttcagggtcatatatctagtaagtagcagaggtaggcttagaattcaaatccaggtctgtgcccttagccactatactacattctcagaagaaaagtgtgattaactttcatgggttgagagagagagagagagagagaaagggagagagagagaaaggtgagcagggaagggcttctaaagatgacatctaaggtaggtattaatgaaaacatagaaaatggaaaactgtgttagagaagggagaggatcattccagatatagatggcaatacactgaatatgtgctcttccatttgggttagcaagtggagaagataagggtggagataatagggaagaaaaaaataaaaatttcaaagttctagtgcagcctggcagaaagaggagttcctgggtgccaaagagaacagcacgaaggcacctgggcgggagggtcaaggcattacagagacggaaggcagtggcagatttgaggagtcacctgcataatctctggagatagacagttaatttgcatgtctgccacttacaagctatggggcttcggccaatttctccaagccctttgggtgttaatttcttcatctgtaattaggtactgatcacagtaccttcttcggagaattgttgggatgcttaaatgagacaatacacataaaagaatatgaacagtacctggcatatagtaaatgcttaataaattatatttgttttacttttgcaaaatagtaattcctaatttagcatatgctaaacatcataggagcctggtgactctcaaagtgtggtcacccagtagcactggcatcatctggtaagttgttagaaatgcacatatgcacattctagagatccacctcagtcctggtgaaccaataagcctgggagtgggacccagcagtctgttttagcaagctcctccagattatctgatgtgtgagaaagtttgagaaccattattctaagcatttcacatgaatcaaattcatttattcctcataacaaccccttgtgagtgaggtactattatcatctctattttacagatgaggcacagaaaggtaaagtccaggatcacccagctagtaactagtggaaacaggatttgtaccccatttaaattttttttttaatttcaaaaatcttttagcacgaacctttctgtgtttcttttcacttccttttggtttcagatcatatcatagccttttcccttctatcctgatgtttttggtatcctgcacgaaaaagaaccagctatggctttctctacaccctttttgacccattgctctctaacacccataatgctttgcatggggctggtaatagacgaaaagtcaggtattgtttaggccgctccacttgaatgattctgtgtattgcctgctgagatggagaagtctgatgtagaaaacaccattgtcagcagtgtcaacttagattaaaaaggacagtgactgtttggggaaccattagacaaattgttttgactcgctctaacaatttaaatatctttcattttattttgcatataaaaagatttgaatttcatgacttgaccacaccaccaaatcatctctgggcagaaagtgcaatcctgattgaccttaagtgatcaggcttttttatcaatatgctcctaatcagcaggcatattaaggtctggatagcatgaactctgcagtctgaaattgaaatggtgcctagtctcttttctttagtaggcatacctaactttctttatttcttagctacattgatggcatgttttcaggaatggctggtatatccttaaaaaaacccagggccgggcgcggtggctcacgcctgtaatcccagcactttgggaggccgaggagggcggatcacgagatcaggagatcgaaaccatcctggctaacacggtgaaactccgtctctactaaaaatacaaaaaattagccgggcacagtggcgggcgcctgtagtcccagctactcgggaggctgaggcaggagaatggcgcgaacccggcaggcggagcttgcggagagccgagatggcgccactgcactccaacctgggcgacagagcgagactcggtctcaaaaacaaaacaaaacaaaaacccagaacagaacatgcacttatgcactttgggccagatctgaaagattctgataattctaacccctactaaaatctagttcttcctgaagaattagaacaaatactccactaactttggctcttaaatactcagattgtaaccatgcctgatctctatacaaagggataaggatcttattgctttggaagacctaataatattcagggaatggatatttggtaagatttcttgctgattatgacctttttggagggaaatctaaatgatatagatgtataggaaggtatcttatattgtcatatgaagcaaaagaactacaaggaatgatggggattataattacaagaaaacagttctcaaaaggccacgttatattctaaaatgtatttttaccttaaaaatgtcagaatatcctacaagctctctcatgaccgatttatttttagacaggggtgtggtagtgattaggtcttgtcataaataatttttttttattaaggtgaaattcatgtaacataaaattaatcattttaaagtgaatatttcagtgtcatttagtacattccaattcaaccacgacctctatctagttgtgaaatattttcattactccccaaaataaatctcatattcattaagcagttcttccccattaccccatcccccaacccctgacaacaccagtctgttttctatcgcttatggatttacttattctggatattttacataaattgagtaatacgatatgtgaccttttgtgtctggcttcttttacttagtacattttcagggtttaacgacatcatagcatgtatcagtactttattctttttatggctaaataatattccattgtatgtatatatcagaatttgtttatccattcttcagttgatggacacttgggttgttttcaccttttggctattgtgaataacgctgctataaatatgtgtgcatatgtgagtatttgttttcaattatttggggtataaacctagaagtggaattgttgggtcatgtggtaattctatatttaatttattgaggaacctcagtagctgaaccattttacattctcaccagtaatatatgagggttccaatttatccacatccttaccaacacttgttattttccactttcgtttttgttattaaattctagccatcctagtgggtgtgaagtggtatctcattgtggttttgacttgcatttccctaaggactaatgatgttgagcatctttcatatgtttattggacatttttatatcctctttaaagtaatatctattcaaatcatttgcccatttttaagctgggttgtttggtttttttgttgttgagttttaagagttttttacatattctagatactagatctttatcagatatatgatttgcaaatattttctctcatataaattgtcttttgtcataaataatttgattttcttctctttgtcataaataattcgattttcctcttttcagttacattatacaactgcacttctccgtcacccctgcatgagagaagtagggacatgcatcacttttaggcggaagctctgaaaactagcatgctatttgatttaggtgatcccaagttaattccccagccatgggtaatactccagatcatagctgctctgtcagcttgcatcttagaatgaggatgtcatgtagcaaagtctaccagttgactcaagatgaacatgtatcacaaaaaacaaacttttgttgttttaagccatggaggtttattgttgttactgcaatgcaatttagcttttcctgcctaattcaaagggtcaagtaaatcactaacacgattatcatagggagtagttactgcattgcacagtgtttcctacaaatgaaatcatagggaaggaaagttgtgaattgcacactaactgggcaaactgcttttgttcttcctcttctcctgagtttttatacaataactggtgttagtttttaggaaccataaatctgattaggatatgggttgagcaacctttatttaaaatgcttgggaccagaagtgttttagatttcagattttttttgaatatttgcatatgtgtaatgaaatgtcttggggatgggacccaagtctaaatatgaaattgatttatgtttcatatataccttatgtacatagcttgaaggtaattttataaaatatttgaaataattttgtgcatgaaacaaagtttgtgtcaggtatttatatgtggaattttccacttgtggcatcacattggcactcaaaaagtttcagattggagcatttcagatttcagattttcagattaggattgctcaacctgtattatcttgctcaaagtccttttgtgacttctaattgccccaaaatccttaacatggttcaaaatctttaacacaatcaacaaagcccttcatgacatcacccttgcctacctcttcagtataatctcatgtcattcttgctttctgtttcttggattattttggtaaatacatattttcctagaaaatcatccattccatctaaaattcagttgttttccacatttgtttctacctcaggggctttgcatttgttccctttcctagggatgttcttcaccactacccccaccacctctccacctcctttgctgctgggtcaacttcacccatctcatgagtattagaataatttcttaaggaggacttgcttgatttggcactctgggttaaatattttttgtctgtgtcctcacagcattctagtcctttggctggcccatcacttgtatgataattataattgcaatgaatctgattacttctatatcttactctaatagaatataaactccttgagggcagagaccttgcttatattattcaatgttgtatttctagtgctttgaatcatgtctggtgtgtggtaggaaggaagaatgactgaattcatttttcagccatcttttacaaaatcaaggtagagctagggctcagtattcaatcatatatttgacatcatgctagctttactacctttcatgaaccagtcttgtagtctggaatcacaattcaccttctgttgtaagcattttgaatttatgaaaaggctgcatctttctgatattgatagactctaagtttttttaaagtctcattttcaagaaatagagttcagagttgccttattagtctggggcagctcaagcatgcttaaatctctgagcctcttatgaaagtggctatgattacagatcaaggatgtagtctactttaatagtcctgatgtgtacttttaacaacaaagatgctgttctagtttcagttatttggggtttattatcattttactttcatcttttatatatgaggacaaataaattataagaagtagaaaatattctgatttttcccccttaaagaattaagcagaacattcaattctattctattgcccagctagactgtattacttttattctacattcacaagcatttattgaggagctgagcacttagtcttcttctgggtggggcacacaaagtagaataagatatggtccctgtcttcaacaaattcattatttgggaaaagaaatcaggtgcaacttcctaagtaaatactttcatactttatatctacataacactcttacccatcaatatagattaaaaaatctgctgttattacaatatggtccagtaatgtgattgatggatatgcatttaaaagatgttcagtttatttaactacaacagatatagaaacccatccattcagagactactgcataaagctgaagataaagctgcgtgaacctgaatggatgtattgacttctcaggtctcccagagttttccatagtgacttacaactgctgatgacacatggtatgaggagtctgccaagtgtaagccactcttctttgttaatctcatgggtggtttccatgtattcttgtcccattcattctctcttccaccagctgttagagactatagctacttgtgttcatgctcaccaagtacaagtaagtggggcaaaaaatctcattacattctgattgtttacagtaagggcaggaaattccaggtcaatttcctaagtgtagtaactctcagcaagacagggcctctgtgttgtctaagtcagaggatgacattttcttttaaatgaagggaaacagtaaatattttcagatttgtaggccatatataaatgaatgagtgcatttattcacaaatgaaacttgatttacaaaatggggcagttggctggatttggcctattagccacagtttttccattcctgggcccagtcagtggggcatcattcaatagcagtatgcaacctgtgaggctctatagaacagtcctgcttcaagcctgaggtatgttctaggaaaaatgattttaaaaactgttgagttatcctcatcccttccacaaaattgcattgaatctacaaaatctatatagatgcaacatttctaatgccacttatatagatcaggaaattatgtttaagatgagaggtgaaagataaacaaaattaagtgaggtaaagaggtaggcaaagagtattccaggcagaggaaatagtacgtgcaaagatcaagatttgagaaaggaggtagcatccatggtaggcattgttgcctcctgaacatccatatgccctttgttatttttaatgggatttcaattttattaagatatccaatcctatctctggatgtaaaggggaatactgatagtttagactaataaatgtgcagcattctcttggtgactgttatttgtccagcagttggcacctgacctaagttagcctaataaaacatagaacaaagtacctagtccatgtttcaaggagaagagattttcccctctctgtcctcctggatatgatcaaaaaaagcttgaatcccttatttccattgccaatcatcttgctacatagaggctaaccagctttaacatgcaaccaaactgtggagagcttagcacaaagctgaagggaactgatttctatcatacctagagcctgccatgctattgaaccttcagttttgagttaataaatttcctttttatttgaactaatttgagggaggtttgcctgttacctacagtcataaatatcttaagtgatagcatatttgataaggtgaaagaaattctaccgagatctataactatatgtaacaaaactattgagtggaacaaggtgaggctggagaggtatgcagaggcaaagtcttgtaggccttgtttctcctggcaacgtacactagtttcagggcatccatacagaaagagtccttctcccaaacaggcagacagcaaaagataaaaagagaaggcatgcttatgatacttagaactttatttgtataaacaccatagctcagtccgtttaagccctatatatttatcactgcttattcttgtggtttaactagttccattttatctacatcgatttcacatcagagatgttagggccaagcaaatgtttttgaatacagtaaaagatatgaaaataacattggagggcttcatgttgttccctgtttaagtgtcagagtcaagtcctaaaagactttataaaaaattattccagaatgaaaaaaatgtaataagatatggagaaaagatctaagagactgaaactttccaatcacatgaagaacagattaagtaaaagcaaaaaccaaagttgagaagaaaactttgagctgaacagggtcaatataacgcaaaataaatgaggcaagtaagaccagacattttctggtgaaatttttataattgaaaacataaaaataagtcctacgaacatgtaggtatattaaacattactccatttacactagggacagtgtagggggagaggagagaccaaggaatactgtttcatacttgactgtgagaagacaaaaaaaaggtacaagattttaaacccaagagtaaattaaaaacgtggctatttttttcccaagtagctaaacagaaagcaaagaaaaatatagtacataaaacaaaccaaacagcaagaaaatattaaatagtttcagacttaattgacaaaagaaagacacaactatttgcaacttatgagagacatttaaaataaagcgaaagttaaaaataggcaaaaatataacaaggtacaataaaaattgtggtcattaaaaataaagtagaattcaataagtgagacagtatcattttatattggtaaaattgcatatggtcaatgaaaataagaggcatggcctttatataataatgaacaatgtggccaggtaatgctactaagtaattaagtagcaccatatgtattacttaatttaatgttcagaataatattatgtggtagacgtggttattatactcatattacagataaaacaactaaacagaaagagattaaataacttgctcaaggttcttactgttaaggacataactggaatttgaacaagggcctttctgactgaagaatctgtaagatactacaccagtgttatctgaaagattaatctgacatcagaattacctgaggtgtttactaaaaatgcaaactcctggcatcacctcagatatattctagagcttggaaatttgcattttaacaagtattctacttgattcttatgcatggtaaaatttgagaaccactgcctgtggctgtcttgaagaaaatgagagaaacacaactgaagtggaaagttttaatccaccttttctagcttagattaaatagaagaaacaataaacaatttaaatattaatcagagtgccataacaaacttaaaacagtacagagactatgcattactttcaaatatgcattttacattttcaaaattgattacatattagatcctaaaagaaaataagttccaaaaaacaaggattgtaaagatcataatatttcatcataatgtgatcaaactaaaatttaacaatttaaagaaagggacataaccaatacctttctaaataactatttaatcaagtaagaaaatttatagctgtgactatagaactccattagcatagtgtatataaaaatttatgagcccacccaccagagtatctaaaatgaaatacaaaataacaagtttttttttctcattttaaaattatttttaatttttgtgggcatatagtaggtgtatatatttatggggtatatgggaatatttttataaagcatgcaatatataataatcacatcagggtaaatggggtatctattacctcaaccatttaacctttgtgttataagcaatccgattacactcttctagttataaatgtatattgttgactatagtcaccctgttttgcgatcaaatagtgtgtcttattcattttttctaactattttttggtacacattaaccatccctacctcccactgcagccctgcactacccttctcagcctttggtaaccacccttctactctcttatctccattcaattgttcaattgttttgatttttagatcccacaaataggtgagaacatatgatgtttgtctttctgtgcctggcttattcggttaacataatgatctccagttccatccatgctgttgcaaatgacaggatctcatccttcttcatggctgaatagtactccattgtgtataagcaccatactttctttttaaattttttttattatactttacattctggggtacatgtgcagaacctgcaggtttgttacataggtatacacatgccatggtggtttgctgcacccatcaacccatcatctacattaggtatttctcctaatgctatccctcccctagccccccacacccctacaggcccccgtgtgtgatgttccctgccctgtgtccatgtgttctcattgttcaactcccacttatgagtgagaacatggcagtgttcggttttctgttcttgtgttagtttgctgagaatgatggtttccagcatcatccatgtccctgcaaaggacatgaactcattcctttttatggctgcatagtattccatggtgtatatgtgccacatttcctttatccagtctatcgttgatgggcatttgggttggttcgaagtctttgctgttgtgaacagtgttgcaataaacatacgtgtacatgtgtctttatagtagaatgatttataatcctttgggtatatacccagtaatgggattgctgggtcaaatggtattcctagttctagatccttgatgaattgccacactgtcttctacaatgcttgaactaatttacactcccaccaacagtgtaaaagcattcctatttctccacatcatctccagcatccattgtttcctgacattttaatgatagccattctaactggcgtgaggtggtatctcattgtggttttgatttgtgtttctctaatgaccagtgatgatgagctttttttcatatgtttgttggctgcataaatgtcttcttttgagaaatgtctgtttatatccttcgcccactttttgacagggcttttttttctcttgtaaatgtgtttaagttctttgtagattctggatattagccctttgtcagatggatagattgcaaaaattttctcccattctttagattgcctgttcactctgacgacagtttattttgctgtgctggagctctataatttaatcagatcccatttgtctattttggcttttgttgccattgctttcggaagtaccatattttccttatccattcatctgttgatggacacttaggttgcttccaaatcttcacttttgtaattactgctccaacaaatataggagtacagatatctttttaatatactgatttcctttcttttggatatataccaagcagtgggattgatggattgtatcgtacgtctattttcagttttttgaggaacctccaaactgctctccattctggttgtactaagttacatttccatcctaatttgcattcccatgagaagttcatgaggattcccctttctccatatattcaccagcatttgttattgcctctcttttggatataagcccttttaactagggtgagatgacatctcattgtagttttgatttgcatttctctgatgatcaatgatgttgagcaagaaaataacaagtatcgacaaagacataaagcaaatagtactcccacccattgctggtgggagtgaaatagggacaatcactttagggaatggtttggcagtatctgattaagctaccaatatgcctcccctatgacatatgctcaccagcccccaaatgtaaacttcctatatactcaatgtagaatgcataaataaattgtggcatactcacacaattgaatactatatagtagtattcacagaacaatctacaattatataaaacaatatggatgaaacttataaatataatgttgtgtgaaagaaaccggacacaaatgcatacattctgtataatttcatttacgcaaagtacaaaacagtcaaaagtaatctatgatgctagaagtcagaatagtgattaccttggtggtaacgactagagagtatcatgaaaagggcttctggaatactggttatgttctgtgtcttggactgaaaactgattacataagtgtgttgagtttatgagaattcgtcaagctgtacatttataatctctgcacttatgtatgtatatgatattttgatacaaagttaattaaaaacttatgactagattgactatgcttctatgtttatctgagacagatttgagaaagaaagaaatagaaattatgcaaatgaaaaataagatacctgaacttaggaacttaggagcttgatggacagattatcttataactgataagagaaaactacatgtaaagcttcatggagagatgaaaaatggtgtggtggggggaggtaaaaacatagagggtagagtgggaaactctattatatgtttaactgaagtcccagaagtctacagagaaaaacggaggacagagagaatattaggggagaccttaacagagaattgttgataattaactgaagacatcaaaccacagattgaagcatccaaactaatcccaaatgggataaatgaaaataaatccatgcctagacacatgataagattgtggaataccaaaaccagtcattaatcagagaaaggatatgttactttcaaggaacaacagatatgtcgacgtctgaatactcaaaggcaacaatggaagtcaggagtctgtgtaataaagtcttttatgagataaaaaatgtaactgtcaattatagaattctatatctagctaaaaagaaatatcctttaagaatgaaggcaatataaaaaacagcctgagataaatgaaaatctcggtgagtttgtcacaaagagagctgcaggaaaggtaacgctaaagcgtgtacttttgtgcagcagaaagatgatcctagatgtcaggtcagagtggatgaaaggaataaagagcaaggatgttagtaaaacctggataaatataaataaacattgacagcttaaaataaataattattatataataatgccatagtaaacaactgaaagccagtataggcaggaaagcattagttaagataaagagggccacttcatgatgataaatgacaatgtttgctttatatattttgattccatgttactggactatacagttttagacttattatattttcctggtgggttaaaccttttattattatgaagtgacatattgccagagaaaatttactaagtacaatgatagggatgtgcagagaatacaaggcagcctagagaggttcaggaaatgagggatggttaaagaacaatgactggtcagcctttctgaaggaagttatatctgaactaattctcaaaagatcataaaggagttagtcaggcaaagtaggacatgccaaacaaagatgatagcatgagcaaggcataaatgcaagaaacagcaaatttgctaggagcgtgaattgtgaggaaggaaagaaggaaggaagaaaaaaaggaaggaaggaaggaagagtaggatatgaaagcagataaataggaggaaacaaaatataaaagttttatgtcaatctaagaaccttggaattaatcctgtaagcaatagaaaaccatttaatagttaacatggtggggatagggtgggggcagagtgacaaggtcatactatatttcagaaggatcactatagtagttgtctggaggacagagtggagtagggcaaagtagacacagataaatttgttttggagacattgtaattattctgaccacagatgatggtgacatgaactcaggtagtattagtgaggatgaaaagaaaacacatacaagtaaaattatataggcattcacgaaatattttttgaaagaatggatgtgattatctcaagcaatatccccctaaaacagttcattggataattccacttctaagaatttatcctaagattaattagaattattcacaaagatttatgcagaagatattctgtgtaaacagtgccgaattagatttttaaaatattgaaaataacctacaggtccaacagtagaaaaatggttaaataaattacagtagagccctaaagttaaatattatgtagtattaaaaagggttttcaaaagacacttaatgacaaggagaaattcttaaaatataagcagaatgaaagcaagacacaaaattgtttataatgcagtatcaattttagaaaagatacatttttgaatatacgtgaaaacatttgtgtggtgggcagaataatgccccccttcccaaagatgtccatgccctgattcccaaagcctgtgaatatattaccttacatggcaaaaggaactttgcagatatgattatgtttaaggaccttgagatgaggaaattctcctggcttatttctgtgggttcaatctaattacactggtcctcacaagtcgagaatcttacctggctgtggtcagagggagatgcttctattgaagaaagtcacggaaagttgcagcttcgctgcctttgaaaatagagaaaggagactattagccaaggaatgcttaaaaaggcaaggaaatgaattctctcgtagaacttccagaaaggaatgcagctatgacaacaccttgattttagcccagtaagccctccatcagactttggacctacaggactgtaagataataaatttgtgttgttccaagttactaaatttgtggtaattggttatggtctcaaatagaaaactaaagtactttgaaaaaaataacaccaagaagagtgttactggagcgaccgtctcggggtggtagaattctaggtgatttttactataatgataatggttttgggtatgttctttatcatctagagtggaagggagggacagagggagaaaattggtagtcttctctaatcttgtgtataaaatcttatgcacattcaattatttcctctacatgaatttcttgaagtggaattactgagtcaaaggctacacacatttttaagctccttgaaaattcaatggcagattcctttccgaaatattgtaccaatttgtacacctgaccaatatttcttttccctgaaattttggtgaatttgtcatgctggttttcttttattcactttatgacccccaaataaataaattaattaaacactactaaatacaaagccaagaaaaaggaagctaaacctgaaatacaagttgaatactgtattttcaagttaccttgtaacatgcatacttgggcccacttcaccttatagagcctgctcagcggtacttcttaagccactctaagttctatgactccagttcattattacttgctttctcattactctgttgaaattcagaagggccaacagcttcttcaaggtttaatagtcattctggaacaccctaaagtgcccctccttctaaagagacatttctttggcataacctcccttgtagcctttttttccctttcctgcatcacgcctctctccctgagattctctctgtaacacgtttccaaaataagtgtttaagtacctgaatctttaacaagtctgtattttgctaggattgaatcttcactttgcctgtggggggaggacatcattcttcagctgattccaatcaagacactcaggctggtaaataacattaaggtgtgtctttaaaggacagattaaatttcaaaatagaaacaaaatctatgtgacccttattatttgctgcacagtgttcctgaaaactattataaactgaattaaattttttgtagaaacaattattattgggttcaataactgcactaaggattcagtagctaaaaaatgatagctttaagcaatgatatataataaatatttttgtcttacaaatgttttctaaaacatgtatttaacacgcaaaaaatgcagcttcactatcctatgtcaatcaaaggtgtgaaaaatacattacatattccacatttaattaataacattttcatgtctttttagaattcagaagacacataagggaatgatttagataacccagttgtcttttaaaaagctgtccaagtaatttttaactgatgtcttctttttctcttgatatatctcccaacacgaagcagtgacatttaaaatcattcctctgaccttagaactactctcaaagtactaagtactcaacaaatgtttcttgttgatgatgatgattgcattcatcagaccaaaaaacattttcaagcgtaagggctgacccaccatttctccctttcaccctctcttacctcccacagtttattcaaagctacagacagagctagtcaaccttggagtgaagtaatatcacgaggaagcacaaagtgttgttaagtcatttcttttaatcaccctttgctgccacagtggtagattgccagctctattcaatgtgattatttcggcctgactaccctactatagaagatttgagcagcctaccctgtaacctctgatcttgttcctctctgaatctcaatccagaggaaacccctttccctaaacaaacaacaaacaaaaacagaacactaggtagactagctgttagcaatctgagaaatagaaaatgttttctatacaaccatcattgttaattgatacagtccaatgcccaataacttacccatttatgagatgtttatcaacaagctactatgaaagatacaaaaactgtaaaattattttttaagatgcatcctgagcaattcacattttgttaagggttttttaaaagcaaacaaaccaatctaccaggttatgagcatcatcttttaaaaaggcgctttcagcattgtcttatttgaaaagacaggcataaaacagtatctgattgtgctggagactgtggaaaacactgaataaggggataaatttgagcagaaataatgtttgagcctttgaagcaaaggcaacgttgaaagaaagaggtagtgcattgtacaactttgaatcccacatcttcatcctcttagcagatgccttgattccttgttttgttaaataaaagtaagctctcccttgtctctgaaatttctcaatgtcacccattcaattgtccttcttacctacttcaatgcaagaaagaagcccatctcattcaattccactctttccagaactatggaaatttgtctacttccatttcacgcccacatttcctacatcttcaatctcttccctgcactagcttattctgcttagcttttaagcatgatcaagtcttctcatatgctaaaaaacaataaaacaccaaaattccctatcttaattctgtgacttcttttaaggtgcttattcttaagctagaacttactgagctctcactatgttccaagcaactgttcctaactcaaactctttacatgagttatttcattttatcctcacatcaaccttacgaggtaagtaatattattcccaattgacagagcaaactgaggcttctgagcttaagcaacttacccaaaatcatgcaagtatttagtggtggagttggaatttgaatccataactaactccaaattctaagctcttaagctcttaaacactgcactgggatacatgtgctatttctttctctctctccccctctctctccttccctcccttatgtccttcttcattcccccttttctttcattattctctttttcaaaagaatacacatagcctctatgcttccctacctcactcattacgttctggcaatgatttttgcttctacaactacattacaatcactctatcaaataatcttttaatcatcaaatttgaccttttctttccctgtcatttttcaggactcatcttttacctttctagagcatttaacacagatgaaaatatcattgtttttcatattcttttttcccttgactgcagtaacattgtacaatcccagccctaatttgacctgtccaaaaattcatttgttcattcacttattcatctactcattcattcaataaatatttattacaaatttatcttgtgttgggccttgttctgtgtgctaagaataccaccacgtagaagacaaagtttctgccctcagagagcttacattttagtggagggtgagaggcaataaacaaaattgttaaaaagagtgtattagtccattttcacgctgctgataaatacatacctgagactaggtaatttataaagaaaaagaggtttaaatggactcacagttccacgtggctggggaggcctcacaatcagggtagaaggcaaaaggcacgtcttacatggcagcaaacaaaagagattgagagccaagtgaaaggggtttcgtcttagaaagccataagatcccgtgagactttttcactaccacaagaacagtataggggaaactgcccccatgattcagttatctcccaccaggtccctcccacaacacgtgggaattatgggagcaaaaattcaagatgagatttggttgaggacacagccaaatcatatcaaagagcaaaatatatgatgtgttattaaaaaagaagtgtgtctgggctgaggaactgcaaatacaaagtttttgacgtagaaacagcatggaagccattgtagctggaacacagtaagtgggaggagagaggtaggtcagtggccagagaggtaagctgaggccaaatcatgtagggctttatagaacatatgaggagtttggattttgcttggggtgagatggaaagtcattggaagatttgagcaaagtagtaaacaaaatatgacttttaagtaatcactttgtctactgtgttgccaacagactgaaggaggacgaaggtagaagcagaaagatcaattctgtcataataatgtcagtgagggctgggtgcggtggctcacgcctgtaatcccagcactttgggaggccaaggcaggtggatcacctgaggtcaggagttcgagaccagcatagccaacatggtgaaaccccgtctctactaaaaaatacaaaaaattagctgggcctggtggcgggtgcctgtaatcccagctactcgggaggctgaggcaggagaatcacttgaacctgggaggcagaggttgcagtgtgctgagatcgtgccattgagctccagcctgggcaacaagagcaaaactccatctcaaaaaaagaaaaataataatatcagtgagaaaggattatgatttggaatgtgttaacagtggaggttgtgacatgtgactgaattggagatacagtttgaaggtagtcctagtagggtgtactaacagatcaactgtggagtatgagatgaggagagaagtccagagttttggtctgagtttgaggaaatccaggtgtggtggaaactgaaaattatacaagttgtgaatacaaaattacatataaaaataaagtatgaaagtaaatatttcttttgaatgtgtagtggcctgccttccagatggcccctaatgatcttgactattctctctcatgagagatcctgagctgaaaccacctagctaaatcattcctgaattcctgacccacaaaactgtgtgagatagtaaatgtttatattttaagacattacattttggaggagcaatgttttttaatgcaagaaaatatatctagaaaaacttttggtgccaggaatggagtgctaccataataaaaacttaaaatatggagaagctttggaactagtagtgagaagaagctggaaggattttgaggagatgttagtaaagatgtaaggaacatgaaagagacttagcagaatcttgatggacattaaggaagctgaagatgaggtcttaaaggaaagtaggaaaatgttattgaaaactggaagaaaggggatccttgttatacaagtgttgaaagttaagcaacactgtcacctatgtaatgtggaaagtagaaaatatagtacctgaagaactgcatgatctagctatggagattttcaggcagaatgttgagggggtctcctggtttcttcttgctgtttacaacaaaatatgagaaaagagtggtaagcttcaggaaggactgtaaaacaaaatggagccaggcttgctggttttgaaaatttccagcctctccagatggcagacattattgaaattaagaaattgctttggggcaagtatcaaatccaggtcacagtcagaaaaacagagtacaaaagaaaagctcagaatgtctgtaaaattctttaagaccttaaaaaaatgcaaaatagtgcctcagagatccatttagttaaacaatacgacttccaagaggttgaagattgttgtccctcgagagtctcagtagaagctcagggtagaaaaaggcttatcttgaggagattttgttccatggagtgaaccccccaaaatattcataggatatatgcaaagtttgaaaaataattatttgaaagaaacactgctagcttgcatttaaagggacagaaagctacaaaatgaaaggaggactttggaccctaaaactttttttctatttttttttttttttgagacggagtctggctctgtcgcccaggctggagagcagtggcgcgatctcggctcactgcaagctccgcctcccgggttgaagccattctcctgcctcagtctcccgagtagctgggactacaggcgcccgccaccacaccaggctaattttttgtatttttagtagagatggggtttcaccgtgttagccaggattgtctcgatctcctgacctcgtgatccgctggacactaaaacttctacagacagggaagcaggttgagaaaactgtgcagctgaaaacatggactcagggcagaaccaagagcacaggaggcagagccaagggccgtgccaaataatttctgggcgggagtagcaccaaagcctaataaaggaacttccagcatttgcccagctacatttcagaatttctttggaccagtgtacctcctgttttcctccctcttaagcaagagtgtctgtagtggctatcatagctatgcctctcccactattgtacactggatgtgtggagggcagttatatggtttggctctgtgcctccacccaaatctcatctcaaattataatccccacatgtcgagggggggacttggtgagaggtgattggtcatgggggcggtttcccccatgctgttctctgatagtgagggagttctcatgagatctggttgtttgataagtgtctggtacctcccctcttcgctctctttcgctctctctcgctctctctttctcaaaacctgaaaggtgtttgcttacctttcgccttccaccatgattgtaagtttcctgaggcctgctagtcatgcttcttgtggaactgtgagtcaattaaacctctttcctttataattacccagtctcaggtaatattctttatagcagtgtgaaaatggactaataacggcaggtaggttttctctttagttgacaggtctttggagcaagaaaaagtatttacgagggtctgtacttaagaaactgtaatagaggagcctcatctacaccagggcatgatttagatcaggtgattccaggctctgagctaatgttggaatgatattatactttttgggacttgggagagagtgagtgtatttttcatatgggaggggcataaatctgtggtggccagagggaggactgtggtagcaggtctccaaactgatctttagtgattcttctgtcctggtatttatgctctagtgtggtcccttcacaccctgaataggactggtctgtgtaaccagtacaatagtgcagaaatgacagtatgtgactgctgaggttaaattataaaagacattgtgacttttaccttgctatttttgggatctctcacttttggggaagtcagctgtcatgctgtaaataaccctattgagcactccacatgggtagaaataaagatctcctaccaacaaccagcagaatttgccagtcatgtgaatgagtcattgtgggagtggatcctccagcttcagtcaagtcttcagataactgcagcccgggccaacatcttaactgcagcctcgtgagagactctgaatgaaaactaccaacttaagattctttgaaattcttgatccacagatagcataaaataatacctggtttagtaagttaaaacactagattttagggtaatttgttatacaacatgaaaccttaggtgggtccgtgaaagtaatttgtgatagacaactgttacagaatgacacatgatatcaaaataaatcatttatttttaaaaaagctgacacaaatctaagaacataacataatacttttattaattaactgcctagtacaccagtatcctatttttttctatagtttttgtctgcatattctttgaaaaaaagacaatattctttctagcatggttactcaattttttattactcagttttcacacttttttttcagcttcacaacatgttattggtaatgtcatgtacagtttcagcatttttgttgaatttgggaaacctatcaaatttatttaatttatgtgaagcatgagttcagagtacttcaaattttttttgtacagtgagtaatattaaatattatatgaatagatgatactcattaaccagttttgagtcaatgtgcttgttgtagtggaactattatgagtttcatattatcttcatcaatgacagtacattgtgtcaaatcagcaagaaatttgaatctttttccaatttattcatatgattcacttctcttcactatttggattcttaaacactccaagaacctattcattacttctattcaaaatgtatctcttcttaatgaattactgcttttggcataatctggaaaaatgtttcatttctcaatgtcagaataatttttattgattcaatcactcatctttatcacttttgcttcatgtttcattaattttttatctgaattttctctgtgctttaataaatatacttaaagatgacaaaagaagtacctttcgtattcggccaaatcaggagtctgtaaattttcacttgttttactgaaactttctgtgatggttaattttacatgtcaacttgactgggctatgggatgcccagatagctgctaaaacattatttctcactgtgtctgtgagggtgtttctggaggagattagcatttggatcaatagactctgtaaagaaggtctgccctcaccaatgtgggtggacatcatcttatccattgagggcctaaatagaacaaagctctctcttcttgagcatggacattcatttttctctgccttcagatatcagagctcctggttcttagatctttggacttcaggaattatatggatgacacacctccaacctcagactgggagttacaccatcacctcccctggttctcaggcctttggattcaaaactgcattacacaccactggctcttctggttttctaacttgcagagggcatatcatgggacttattgatttctataattgtgtgagttcagttccataataaatctcctcatatatacctatatatatcttattggttctgattctctggagaatgctgactaaaatactttccaaagaatattttcaagtcatctttacaacatcagaataatttgtgtcttaataaattttacaaaaccatacgactatgtgaatacattgataagacccacatttagagtattgtaagggcccataaaaataagcagcacaaagtctttattagctacacggtaagtccacctctggttctgagaaattacatgaatagtgacgtcctttactaagatgaagaagagtataggaaacttaaaaaagaacagcaggagttcatttttgaacatgttcaatttttgatatctactggtagggttagcatataatttcttgtccaaaccattacacttttgagtgtgaaaaagagcactatttcataaacgatagtttataaattgggaccattccagacaaattgagatgtataattaccctacctattgagcatgtaagtagagatatcgagtaggcaattgcttacagaaggttagagttcaggagagagttctgacctgaagtacaaatttgtggaggggacattaatatttaagtgctatttaatgtcatgaaactaaatataatcatccagagaaggaatgtagagtagacaagaatgctgagatctgagctttgaaatgctcaacattttagaggtcaggaagacaaagattaaccaagtaagaaaagccagtgagatagaaggaaaaccaagagcatggtatttatgaaaccatgtaaagaaaaagtttcgagtgtctgatcatgtgagccaaatgttgctaagtctagtgaaatgagaattcagaaatgatctttgggtagaaccagctgtataatttgctgggtccagtgaaaaaatgaaaatgtgggactctttgttcaaaagttattaagaatttcaggatggcaacaacagagcattaacccaagcataaggctcttgtacgtatagggccctatatgactgtgtaggttacatgaacaccatgaaactggccctgcctttgggccttacaacctgggggccactgatgacaattacaagaacagttttggtagaattatctgagtaaatggctaattgatttttagtgttaaatcaagtttagcctaaatcggcctcctgacatattctaagtttggcctaaaggtttcattgtacatagcatactgtaatttaaatggagatgtaaatagattataacctactcttgtgccaatctctgagatttggccaatcaaaggggggcaactgttcaaactgtgttcaaataaggcaaatgccaggctataaccaatctggctgtttgtgtaccacacttccgttttctgtacgtcactttccttttactgtctaaaaatcttcttccactatgtggctacccaggagtttctctctgcctactctggctcaggaggctgtccaattcatgaacgattctttgctcaattaaactctgttaaatttaacttggctaaagatcttcttttaacactggaaagaatcgaaagagaagtataggtacaaacatagataactgtcttgatgttcttttttttttcttaaaaaattttgaccttttagcaagataaaatgggatggtggctggagtgagtgttaagctcaagggaatgtttgcttaagatgagagaaggacagaatatttgtatgctgcctagaatggcccattagagggagaaattttgattatgcagagtagtaggatgattacaagagcgatgtccttgataaggtgatgagatgggattcagaacacatgtgaagcaacagacaggtctttccttttaacaggaggaaaggcagaatgtatagtagaggatgcagggaagttagtagacttggaggtgaaattgtgatgtagttctcttctgattgcttctgttttctcagaaaataagaagcaagaccatgagttgagaccaaggaggagtaagggaggttgtgttggagatttgcagaataaggagaaggtgtcttttgtttactgttgtacaacttatattagcatggtatctggtacatattagtcacagctacaggagccctccaactctgttctttctactctcaggatatctcttgaccctgttcctttcttcacattctcaaactacccacactgttttacgtctgcatgattccttgcttaactggttttccacctttagtttttctttcctccaaattatcccccactgtggtattaatatgcctgtattcctcaatcaaagaatgttgggtgaataaatcaataaacaaataaatggttacacaaacatcaacatttgacaattacaaacaagatgaattttttttttttttttttttttttttacagaggaaagctaaacataaggcgaaatgtgtggatctcaagcttgggtttagagaactcctacggataaaggtcatataccttgtcaaacgtagagagagaggagaaaaagagagagaaagagaaaataaaaagtaaaattatatcactcttggctttatgtcagagtaacttttgtctctcaaaaaataaaagaaaatgataaaaataagtcaacagttatgttgcttgtctgaaaataaccagaagtttttaagacttttaaaaagtgtttgttattgttttctaatagcaaatcaaatacatgctcattgaagaacatttgaaacaaacagaaaagtgtaaaagacaaaatacaactgctgcccagacattgttaacatcaccattcatttttctggtcgtatattttaaattgacttcatactcttcttacagtgtattctgctatttttagtcatttataagcattctcactgttattaaatattcttctaaaatattcattataatggctgcagtagattctatcatgtaggtgtaccataatgtaagcatttctttattgttgatcatttatgtttagcttttctttttgagtaagctaaaactatcatgagactgaagtatgatcatgatcattatctttccattttgatgagttcagaggagtgagatccagcaggcaattatcagcttctctccccttccttgatctttgtcacatcactttatattctctatctaaactaaagtttatacccttctttctaaagaataattccagggaagcagtccacattttaaaaaacatctgagctctagagcagacacatttttgctactgtcttttttttttttttttttttttaaatcctttaagataacacagcagggacaaaacacttaaaagaaacatactgctataaaagctacacaatctctcttagataacgctgctagacctcttttgaaattggactctacttgtagtttacattttgttatagctgaatttattaagatcccatgaagatggaagtagtgtggggagctgagagtagatgcctcctactttgtctctattcctatttgcaggtgacttggaaattcccaaattacagagaataaaaaaactttgtaattcagagtttgtgaaattcccagaacacctgttttaaaggcatgctgctctgttgatgaatcacccaagctttataaaatgattcatcattaatcattacaaaaaataagcttaacaattcataagctcaaaataatgctatattattagcttcatatttattaaaaccacattactttgactacatttggaaacaaaggaacttctaaaagtttactccaaaaaatgacagaacttttcattccttcaatgttctatttagccatatccatcaaaatgacattttttagcagaggaaaaacttggtaaattacttttttttcctaaaaggggaatagtatttctaggtctttggtctatgtttctgcatagatcattgaatagaaaaaaaacacagtttttttctcttactatactttcaaaactcaacacagaacacttctgtgaacaaatatgtgggtgcctctcccacagcaagcaattctctgacactagctaggtatcccacaattcaagctgacactgaccagagttagtgcagacctcacaggttaagggttcagtcccataagacttccctcacccaacttcagaaaccaatgacaggtagtaagttttcaagttacctacaacttctgtctgacttggtaaaaatcagaggtttgcatgaccccattttcaggttccatttgcaagagcagttcacagactccaggaaaagagtttacttactgttacttatttattacaaaggatattgtaaagaatgtaaatggaaagccagatgaagagatacatagggcaaggttcagagagatcttgagcacaggagcttctgtctctgtagagttggggtgcagccaccctcccagcatgctaatgtgtccttgctcaccaacctggaagctctccagaaccgcatacttttggaatttttatggaggctttgtcatgtaggtatgaacaattactaactcaatttctagcccctcttccctccctctctggagaaggggctgggagtggggttgaaagttccaagctcctaatcatgccttggtctttctggtgaccagcccccatgcaggagcccaccaagacacctcattagaataaaagatgctcctgtcacctgggaaattacaagagttttagaagctttatgccaggaaccagggacaaagactaatatattattatttcacaagcacatacttacctctacacaaaactatgtgttgttatacttaaagtgtgagagtctgggctctggaaatttcctgtcacttggctatgtttccaagtatttgaagtctccatttctaagtcacggatgagaaaactgaggccaggatggttcactagtaagatcagggtcacatctgtgctcaaacaaagctttaaggagaactaacaacccctgggtttccaatctattgctgaaccagtgagtgaatctgtctgtgttttctaggcacagtttagttcagctctgcttttccacacctgcctggggcttttcctaatcagcgtcagaccaggagccttaattgtgatgtctgtagaccggtctctgtctttccttatgtgccttaaaagcatgtatatacaggggaagcttatactgggagtggatgaatacaggggactctatatgctttggaaccacattggagaagctctactggggcaaatcacttaacctatttgagcctttattgcctcatatttaaaatgggattgtcttagttcctatgtttgaggattttatagtatttaatgagttcacttaacaccatgcttggcacaaaaaaggcactctatatttactctagaaaaatagcatactactgtgctggcaaagcattagattgtggatccatcttttttttttttcttttgttctgtgaatgaagctatgaagcttgctctggtgttttctatcatacacatggatgaagcacttagttccagaattaacatgataagagtaagactcctgatgtggtttggctgtgtccccacccaaatatcatcttgaattgtagttcctataatccccaggtgccacgggagggacccagtgggaggtaatttaatcatgagggcgcttaccctcatgctgttcttgtgatagtggtgagttctcatgacatctgatggttttataaggggcttttcccccttttgctcggcacttctccttgttgccatcatgtgaagaaggacgtgtttgcttccctttctgccatgactgtatatttctggaggcctccccagccatgtggaactgtgagtcaattaaacctcttttcttcatagaagcctgagaacagactaatggagtaaattggtaccacagagagtggggtgccactaaaaggataccggaaaatgtggaagtgactttggaattgggtaacaggcagaggttggaacaatttggagggctcagaagaagacagggaaatgtgggaaagtttggaacttcctagagacttgttgaatagctttgaccaagatgctgatagtgatatggacaatgaagtccaggctaaggtgatctcagatgaagatgagggacttgttgggaactggagtaaaggtcactcttactatgcaaagagactggcagcattttgcccctgccctagagatctgtggaactttgaacttgagagagatgatttagggtatttgacagaagaaatttctaagcagcaaagtgttcaagaggaagcagagcataaaagtttggaaaatttgcagcctgatgatgtgatagaaaagaaatactcattttctggggagaaattcaagcctgctgtgtaaatttgcataagtaatgaggagccaaatgttattcaccaagataatggggcaaaccatctccaggggatgtcagagaccttcatagcagcccctcctatcataggcctggagcactaggagggaaaaatggtttcctgggctgggcccagggcgccccctgctgtatgcagcctcatagcatggtgctctgtgtcccagttgcttcggctccagctgtggctaaaaggggccaacgtacagctcaggcatttgcttcagagggtgcaagctccaagccttggtggtttccatttggtgttgagcctgtgggtgcacagaagtcaagaatagaggtttgagaacctctgcctagatttcagaggatgtatggaaatgcctggatgtccagccaaaagtttgctgcaggggtggagccttcatggagaacctctgctaaggcagtgcagaagggaaatgtggggttggagcccccacacagagtccctactgggacactgcatagtggagctgtgagaagagggccattgtcttccagaccccagaatggtagatccactgacaccttgcactgtgcatctggaaaagccacagacactcaatgccagcccatgaaagcagccagggagcaggggagctgtaccctgcaaagccacaggggcagagctgcccaaggctgtgggagcccatctcttgcatcagcatgacctggatgtgagacatggagtaaaaggacataattttgaaactttaagttttaatcactgccctattggatgtcggacttgcatggggcctatagcccctttgttttgcccaatttctctcatttggaatgggtgtatttacccaatgtctgtaaccccattgtatctaggacataactaacttgcttttgattttacaggctcataggtggaagggacttgccttgtcttagattaagcctttggacttggacttttgagttaatgctggaatgagttaagactttgggggactgttggaagggcatgactgtgttttgaaatatgaggacatgagattttggaggggccaggggtagaatgatgtggtttggctgtgtccccacccaaatctcatattgcattatagttcccataatccccatgtgtcatgggagggacactgtggaaggcaatttaatcatgggagcagttaccttcatgctattctcatgatagtgagtgagttctcatgagatctgatggttttataagggactttccccccttttgcttggcacttctccttgctgctgccatgtgaagaagaacgtgtttgtgtccctttctgccataactgtaagtttcctgattttaagtttcccagccatgctgaactgtgagtcaattaaacttctttcctttataaataacccagtcctggatatgtctttattagcagcatgagaatggactaatgcaactcccaaatgcagttatttgtccaggaccttaaataatgttgcaattttcaaaaactacttcaaagttaccttggaaaaaaatagtaatgggcagagcttccttctcatgcttccatttcattaagcatgaaaatagaaatataagaagtgctaagagaaattacctgcccattttattgaaggtttccctcccccaggatggcatctaattgcttcttgaatagttctagtgagttgcttttaaaaatgtgtctttttgtttctaaaagcattttccatatctatgacttggaaggatatgaggttacatcaaatttatacttgctctttggcttaaaatacatgctttgtatacaacagactaacatacattggagcaaataacaggtcccaaatcagaaagaactcaagcactttatcactacaccttgttgttagctgccttggaccctgggtaatttctcttaagggagaaaacgttggagctgcaagacataggattaattactttaacctacttctatttacgaatgtacaattcctgtggatcagtctcaagctcactgcttctgaataacaaaacagcataatttaggctcacccactaaggtcctgtcctcattactgcaaactagacccagaacaatctctttcctaatgatggcccttttctggccattttggcattatttcaagatcatattaagacagtttttcagtaactaccaaaagacaattattatttcaaaaattagagcaataagagcatatcaaactcttcaaaggaaagaaaccctagaatatatagctactgaagatataaattagtgagtacatgaaagtgacaaggaaaacaattctccagccaagaagaaaatgagttgactctcatcttatgtgacatgtgttttcactccttttgcctgaacaatagccagcatcagcagaatccagattttattgtgaccactggaaaatgcttctttccctgaaaagtatgggaaagatatgtaaggaaacggaatttaagaaaaagtgtaatgggaaagtggggtgggagaatttgaagtcccaaggctctaccaaataaagaagccttctcaaccctaaactgtcaagtggtaggtttggcagcaagtccccactctgtaggaccttttgctgaagtcccaagttccatcaggagtaaataatttcttttggttgggggattgtcccttattcaaatgtaagtcccctaaaggattaaactcaaaagttgtcattcctagaggaattaagttactaggcacttcccagcaaggtggagagtgaaaagaagacagaaagggatgaaaaggaggctttggagggtgctaaaacaaactgagaaactgaatggtgaaagattcttcttcctgtaggctatgaagaaaaggtctaactttatagcagaaaccaaatgtttcaaaagagcaagtgcattttggatgggagagggggcatgcgagcaaagggagagttgtggaggggtatgggtgcacacaaagacaatgcagccttgggagctgtttttatattaaacaagattagatatgtgtacatatgtgttggggtgagggtgcggtggggtttgggttccagaaggaatggctggagagttaacattccatgtggccatgtggttagttagaagcctaaactctttttgaggccaaagcatgttgagttgtagttctctatactttgtgctttgtatgctagtatgaggaaaagctttaccaactgtaacccagttgttcgttgactcacgaacttccagctgcgtagaagcagagtctcagccttgcaacctgcaaatgttccccagttatttctgagagtccccagaggagtgcttcatatgtgcctataaactaatcgattggttagtcccactgagtggagtcttctatatttttcttctgttcccatctgtctatatcctctccccttaaaatatcctttagggacttcactgctgttatagaccataatgataaggccattgtctatgtcaaagatgttcctcatcttctgcctctagcttcctttctatataggagcatcaaagccagtccaaagaacacagtgcaaatggagctcattccagctctttgggtctttcactatagtcctccccagcacccctctcccaatcaaacctttttctttctttaaccaattgcaaaacaaaagccctgcacatatgactggaagccattccctgtattttgggcaaaagtgagcatacaaatgtatgtgtattcatgggtaggtgtgggtgaagatgtgatggagtgtgaaggagaggtaaagatgccagtgagtaggtgccacccatttctttgatggcctgattattccaaataagcagactggaatggatggataattactgggtcctccatcacagcaggggaacagcttccacatattcatctacaattggattgttaccagtggaagtatccgagttaccagtggcgaatctgtatgggtctgcggcaactttaatttttgccacttcagaagaaagaattcgactgagggtcaaaaggcagaaaaagagaacaaggtcaatttcagagcaggtgtggatgtttatttaaaaaggctttagaacaggaaagaaaggaaggtacgcttggaagagacccaagcaggcacatgaaggttaagtgcctgaaggtcaagtgccctgtttaactgtgatcctagggctttataggctcgcctctttcccatgcttcttcccttagggtgggctgcccacgtgcgcagtgccctccctatccttgggaagtgagcacgcgcagtgtgtttaggaagttgtacacatgcccacctacctgaggcttccttcccttttccggtggagtgtctctggaaggtcatacgtcaccattttatctctttacgcacatgcctaggaagtagtttacccctggtgcctgcattcaattaacaatttaatgttagcagctgtggatcatcaggagattgtctcttccttgcatcctggtacccgctgctgaattatcatttttagagaggcaatgtgataattgtcggaccatcacctgacattcctagtgggtaggggggaagagccctctcctgccctgccccgctcatgcctatctaattacctgtaacaggatggctcaggttaatcagggagatggtggtcaggaaataccagcattttcaccttccttcggtttgttgtttaaagtagctcaggtcttttgtgagccaggctttctgtgccccctccccaaatgttagaaattatctttgttgaatagaaagacataagcaagattaacattgacttttcagtcaaatttgaagatctgaaaatttccaacagcttctgtgttttctagatgaggaaaatgaagcccagacttttccctatcttttttttttttcttttttttttagactgagtgttgctctgttgcccaggctggagtgcaggctggagtgcagtggcaaaatctcagctcagtgcaacctccacctcccagatacaagcgattctcatgcctcagcctcccgagtagctgagattacaagcacatgccaccatgcctgactaatttttgtatttttagtagagatggagttttcccatgttggccaggctggtctagaactcctgacctcaagtgatccatctgcctcggcctcccaaagtgctgggattacaggcttgagccacgatgcccagcctcctatcttcttcatcagtgttaaaatatcctccaggaattagatggagcccatgtatccagttagaggcacacagtaggcactcaataaatatgtgttgagcccagttacatcaggggcctggcatgttgctttttctccaggatgttaagcaaaacaattcatgagctcaggatatgactactatggatgcatttattccacttgcttagcaattgaaaatgatgaagccatagacttgtccaaggcaatatcgcagaaatgttgatggagtacagaagattgtattatgttttctgagtagaattcagtggttttggaggtggcccttgctaaagattggaagcaggacatgctctttgtaatggtcttatcaactctactagcaaaggatgcagatgcttcaaattacagaggcaatttttactttccaaatgatttcaagactgatgttttaagtggctttaatagaggagaagctgcacagaaaaggtgatctttgtctacctcgtcaaataaagaaacaaaatacaaaataaaagactcttaaaataagcaagaacttcttaaaggattttctaacacaaccacatacatgcataagaattcagaagtgcaggaagccactgtttttaatacaatcaggttcacagcaccaaagcagttgagtagaaagaataagcaaggatgtttgtagtgatattcagaggttaacaaaaaattaacagagccagactccaaatgaaatggttatgggccaagaataactagatgtgtgggagtggaaaaaggctttaaaacgctgaaacctcaataaaagttcagggcaagaagattgaatccaaagtattaacacccactgaaaaagaaaataaagttgtgtgcactaaattggaaatgcttgaaaatcgagatttcactgaaactttcttctggagagaaccattgtttctaactttcataaaacaaaggaaaaaaatgtttaaagaggggatcatatggacatatcattatggtactactaaattgggagaaaaatacaaagcaaagtgtatggaaaggtagcagctaagaaatgattgctattcatttacttttcataattaatccgttgctgacaaagaaaaaaattcaatttttttttaaacaggatgtcactctgttgcccaggttggagtgcactggtgtgatcacagcccactgtagccttaacctcccgggcttaagtgatccttccacctcagcctcctgagtagctgggactatgggagtgcaccaccagcctggctaattttcttttttttctaaatagagatgaggtctgactatgttgcccaggctggtctagaactcctgggctcaaacaaccctcctgccttggcctcccaaaatgctggggttacaggccccagcccctgcatgtggcctacgaaacaaacttgaaagagatgaaatcttggccagatgaggtggctgaggtctgtaaccccagcactttgggaggccaaggagggaagactgcttgagcctagacgttcgagaccagcctgggaaatatagcaagaccccatctctacaataaataagtaaatagatagataaataaataatatctagggaaagataatgctgaaaaactgactgggtgaaatgggctgaatttcctgccatgccacttagatgagtgtaggggtcaagggagagcttccccttcaccttctgaaagtttgctgaaaaggaactgacaaaaagtagattaaggggagaaaaaagacatacagatttattttaatgtgcatagcatagaggaatcccagtggggtccagatatttatgtacccttcttcctaggggaaggggagatggtggtataggagtaaataatttttgggggagaatgaatgaacccgggggcagacatcattttgtgaatgattctctttggaaattgaatgggacgggaaaacaagcaatggtttgggataaagtttgctggaccctaggtgtggtgtttaattttcagtctctgtctttgtgatatgaattttaatcttctctgattaatataatttcaagaaaagatcaaaggcaattgtgtttctctttggtggttctggtgtctatatagataaaggaacttcagaaaacagccacatccacatcctgtgctttggaaagacacatgtgagggtagcaagggttgggtgtggtggctcacgcctgtaatcccagcactttgggaggcccaaggcagatggatcacctgaggtcaggaattcgagaccagtctggtcaacatggtgagacgccatctgtactaaaaatacaaaaattagccaggtgtgctggcatgcacctgtaatcccagctactcaggaggctgaggtgggagaattgcttgaacctgggaggtggaggctgcagtgagccgagatcacgtcactgcactccagcctgggtgacggagtgagactccgtctaaaaaaataaaattaaaaaaaaaaaagacgtctgtataacaaagtggtttctatttttcataagatgttcaagctaatttgatgttatgagaagttgtctacaacaaataattctatacaagtgctttttctacactttacatttatattaattatcctttgtaaagaagagactatattgtgggttttcatattgtcttgtgggaaagtgaggagacagcttaactgtattttgttgagctgggatatataacaaacacttgcccttccattcacctcctacatttccaatagcctcataaccagtttcctccagttcagactccccttattcatatacccttcttactgctgccagaataaactctgtaaaacgcaaatctgacaatgtcaattctttgcttggaacttgtcaatgacaccgaaattgcctttccagactcatctccagttgctccccttaagcacacttcacttaactgtgtcaaattactcactgttcccaaagggaggaagctgcacagtctttgtgcgtcctatttttcatgtccaaaatgtcttttcccaactttttttaacctgacaatgtcatcttgccattagctcaaatgacacatcctcattgaaacgttccagagcccatcagctagaatcatcatgattttttgtacatcttttcagagtaatatttttgaaatctggatctctcttatcaatatgtatatttattatggtggtgatcccccactctactgaaacctgttattctatagtacatctcagaattaaggagccattagagttgtttcctcatctttgttaccgtagcactggcattcattcatttagcatctctttaattacatgcccatgaagtaccagacactatgccaggttctgggaatataatagtgaaagacacagacaagtcattgtactcagtacatttttgtttgagacactgaccaaataaacaaaataaacacaaaattagaaaaaaacacaacaagtaaacctcaagttaaccaacaaataaagtcatggaatttcctgatagtgttacgaagtaaaaacaggtgctgcaatagtgcatcattttggaatgtgtttcttattttgattgtgtcaggtgcaaactcatttcctttcctttcctgggcatatcactggcctacgtttcctagccttcttgcatctaggtggggccatgtgactagttcttgccattggaatgtgagaggaggccagatgtgtcacggcttgtctgaggcaggtaagaacaggtgaaccttttccatattctctcttttctcttgtcacccagccagaaacagaggttacagtggaggtctctgaggcactggggatggcagatcacatcgtgagagaagtctagactcctgaatggcactgtagaatgcttcccaccaatcacctacttggactatgtggtaaataagaaataaatctttattctgtttaggcattggtatattggagctctttgctacaatagttagactgccttgacttagcagtgatcatagcctcccatggcccaggggtcaacataagaatttgagacagcaacatgggtatctccaaaaagcatttttccccctccctcttgcaagctgtcacaaaggatcttgatccccacattcaacatgtaggtaattcaactcttcccatcacatgcccattactcaatcaaggaagtgacattaacagcctgccaaagcaaaagaaccctaacctatcccagaggaaagcttcttagttaggcaagcaaattttctaattgtcttttgttcttctgatgtatagttagctaattatagacagtccctgacttgccatggttgaacttcagattttctgacatgaaagagatatgcattcaggagaaactgtacttcaagtacccagacaacccttctgtttttcactttcagtgcagtatttaataaatcacatgagatattcaacactttattataaaataggctttgtgttagatgattttgcctaatgtaagtgttttgagcttatttaaggtaagctgggcgaggctatgatgtttggtaggttagctgtattaaatgcattatggtattttctacttacaatgggtttattaggatgtaaccccatggtaagttgaggagcatctgtattgctatagacactttctatagtgctttaatcattcttataaccatgaaatagtatcatatgtcaactggaaacttgaagcaaaacaagatgaaagatttgacctctgtcttgatgtgatgacccattgaacacacactgctccaacaagaactagaatgtgtacaaaggcatattctacctgtcaattaattaagcccatgctttttcagtagtcttggttcatgacatacaggctaatttggtcaagcattatcaattatagagaaacatttgctgagactggggcagagataatgtggttgcttccaagtgaagccacacatggctctagaaataaagaatgcagaatattgtctctaacctactttgcctaggctgggtcatttttgctgaaaaggaaataagggataataatttccttaagttcctgtgtacctactgggtcatgttaaaagaatggacagatttaatatttaatgtatattattcaattcagcgtttgagaatatggatggggatgatggtggtcttaatgtgaatagggaggtcatgtgggctattcaggtgaaagaggcccaaatggcatcaaagctttcaaattgctaatgcagttgagaatgtaatatttagaaatttcgtgaaaaaccttacaaatgaaaatctgtaagcttgatgagaaattgatgaatagagacgtgattgttttttactcatcattttattgggaataatgtgctgcttggaatgctctaagatcattccaaaacaaagccaagcaatgtggtatgactgcaactgagaggaaaaacacagtacctggcagccaagtttgacaggatgtccatggctctaaggtgcagaagaagggagcagtgacagattcttccagacacttggctacagacatttaccaaaggaccaaatttcgaatggattcggtatacagagatttataggttctattctggtcattccaggcatctaaatgaaaggcagcacactgcagaataacagcctgaataatgaagtaaaactcacttgtttgaatactggctatatcagttacgactatgtgaccatgcacatattactcaacctctctgagcttcagtttcctttatctgtgaaatggggatacctattcgatgagtattaaatgacataatatgtgaaaaaaacatttatgtagcacagtgattaacacattttaagagtttagtaaatggcaggtattaataatacagccttgaaaaatgaacttcttccacttctactctcaaccctccccccattctcaatatgcatgatatatgcatgggtagatttggcaaatgggctaagcaggagtactgtgaagtagatccacaaagttaagttctaacaatttcattatttcaaaatatttcaaatcaatgccagaaagggaaatagacatgttagcaattttgatacaataagattttgttgatgagtaaattgtcttctttcacaaaaggtaaacctgtcaactttggtcttgaacaaaatcatagatgtaattaaaaacctcagagaataagtggaattatttaaattagattccataactctatattttataattatgggaagctgcttattcaaaattatgtgtaaaggcatgattgtggaatttccttgctaataatggtaaaatactaataaaaaagtccgtttttcatcagttccatggtgcttatcatgtaaccaatttcagtagcattatttcattaatactaattgaaaggggagcaaacttttacagttcaggtttaaattacgcgagagagttaaaaataatggttgtaagaaacgaactgctgttttgtttgtcactacaatataaaatggtttaataatttttattgacaggtcttgtacagggtatattggctgtttcttatgcaccactttgaatcttctggttttgtctcccaacaagtcatacctgtgtgactgagcaggctttgagcagctttgatgaaggcgccatcaaacagtgccttatctatggtcagccacaaatgcctcttacttctctgattccttggtgaggaatgctccaacagtgtatttgacattcaaacaagagcaacctggaagtagagtagggtaaattagtaccctgtaaggcaatctttagccaatggagggcagagctgttggttaaatgcttttcccttccttttaggtggatggtcttgggttgcatttcgtgaagctaattagataagcctacatgattgagcacccgtagtggtggctcagctggtaatgtgtacttgaattggttctctctccttccttgtttcatgcccctgtccctcattcctgctcttggtatcactttcccaaggaaacttactcacatataacttttcttttagattttgttcctgggggaacccaggctagagaattggtgtagatacctttaaagcaattcagagtcaataaggagaaggcccaaatactgtgcgtatttatctctcttctttacgttactcaaaaataaagtaaatttgttatgattcatttagttttatctgtatttaacatttgaagtttgcctttttgctcaaggatggagatataaaatagagatttatagcagagcactgataccaaaaagctcaatgttctaaaatcagtgtcctttctcatcttgcatagtcaccatggtatttcacctaaatcaggaataactgaattaggcgcctggctaagtctacgggtcaagacagccaagttctggtagcattttgaccccatatgacaatggttaagatttaacaatcactttttaggaaaaattcagcttaaagtgagggcaaaaacatgtttggtggcgaaggtgtctttggaactgcttctaattatccaagtcatctttcttctgaggcccgcttagctctgaaacaacaaattaaactgtactcaactgtaatagtaattgcatttcaaatattataaacactgaagttgggttatgcttatgatgtcttaaggatgtggatgacaaatacattttctcataaaccaaccctgaatgcttgacagtgcattcctggggccctgtgttgaaggtttctggtgatcaatgagaaataatccatgatcaattggcccactgaatgttttctacccctgatttaggggtttcaggttgtcatctgaaggattttcttgccactgacatctatccaatttacgaaagtcttaatataagtttgatatcttacaaactctggcaggttcatcattacaaaatccaagtaggatgtattttctgaaaaaagtgacttgcccaaattggggtcatcttcagagagtatgactttagaccttattctctactctgaagcttcctctaagttttggtccagaaaaccccataagagttacagagttactaaatgaactgtactgtaaagtcatatgtgtgtgtcaaatgatttttatcagcttttgggtgtgttactctattaatctgacttactcattagaacaattgaaaatttagatgaactattttacatttgatatcttttaacacatgaacacatcctaaagctcagagaaaatcacaaaatttagttaaactttagttatcaaattatattatctccatttgcctcaacctacatcatttggatcaaatagaatgcaagtgccataacacagatcctatggtgctatatttatttcagatattccccataaattatttattgcaaatttaaaatattgggaaaatttgtagcgcagatagattatccaggaatccttgagtaaatcctctttgcctgttaagaagtgctgagaaaagctgatctaaatgtttcctcatatttttaaatttcactaatgactttaatgcaagttccttgtagagaggcagtggtttctctctgcaagattcatgacatgtttactgccttttttttcttcctgatggacatgtctacactgcaagagacataagatcctgggtatttgaaaattaaagaacagcagcaaaaggccagatgccgtagttataaaagttgcaaaagtatcataaacaccaggtgtgccatataaatgcacaggttttttttacactgccacactattatcatatggttccaacatctgttcgttcctgtccgggcttcccacagacagtatttattaaaatcaaatacgcactaactctcacttatgtgccttgagcaggaagtgccacagtggccttattatggcatgtaagtgggccaataaaaattgatttttatcagtaaagttccaattatccttacaagccaatatagtatcgtctgtatgccttgtacttgctaatgactctgtggtttctatgacagtggggccaatacaaaagtttttgttactaattccaaataattggaggatgagaggagaggccagtttagctttgtaaagagtctctattaaaaattattacttaaaaaatgttattttctgattttcaactagaggacatattcgaaattataaatgaatgtaaagaagtaaatattttaatgaaagtattaaaaggcttcacgaatttatatcataaagtgatacattaaaagcaaccaacctagcaaagagaaaatgacactggtctggaaatcatgaaccttatgttctggttcttaatctatccctaccactctttaggtcttagttttctcatctgggaaaatgagcagactggaaaatctgtactatgttcccttcctattttgattatttatgactctaatgataaaaaaaattcagtgacagaaacttttttctttagctcttgatttaataaattctcccgttttttacaaaaatattttcctgttgacttaatagaaaatatccacattgtatctgagatatcacaaacaccaaaccagtagatttcaaattaatgagtagtttgacagggttgttttttgaacaaaaagaaaatattaaaaagaaatgagaaacaatgtactaccaagtgaatgttaaaagaattgggtatctggccaggtgcggtggctcatgcctataatcccagcactttgggagggtgaggagggctgatcacctgaggccaggagttggagaccagcctggccaacatggcgaaatcccatctctactaaaaacacaaaaaattagccagatggggtggtgcgtgcctgtaatcccagctacttgggaggctgaggcaggagaatcgcttaaacctggaaggccgaggttgcagggagttgagattgcgccactgcaccccagcctgggtgacagagcaagactctgtctaaaaaaaaataaataaataaaaacagaattgggtatctgtttattgggtatctgtttaaataggaatattagaacccccacctacctcatatcatacatagaaataaattccagaaggatgaaagattctaaatatttcttacaaaaccatacagatatgtggcgaacaccgaagaactgttaagatgtctctttgatgaaggacttactgccccagctgctgagaatgctgttagtagatggtcttcagaagattccggccccttcagtgattgcctcagctgcagaaagctgcctctcccaaggtcacaccccttcccatgggagcagtccacatccaatgactgatcacatgcaggaatatataggcatggccatctcagttcaattaaagagctgcccatgaggtaggctgaggttgtcattggcttagcatggcagctcaacttctgcctctgactaattgtttccttttccttcaatttacaggtgttgatgccaagaacgctaataaaaatccagagggctaaagtttgtctcagattctgcatacggaggaactcaagctgtgacaacatgttagaataaaatgtaaaagaatacctatctttttaaaaaatttaatttaatttaattttaagttctgggatacatgtgcaggatgtgtaggtttgttgcataggtaaacatgtaccatggtgatttgctgcacctatcaacccatcacctaggtattaagacccacgtacattaactatttatcctggtgctcttcctccccccgtaccccctgacaggccccagtgtatgttgttcccctccctgtgtccatgtgttctcattgttcagctcccacttataagaagtgagaacatgcagtgtttggttttctgttcctgtgttcatttgctgaggatcatggcttccagctccatccatgtccctgcaaaggacataatctcattcatttttatggctgcatagtattccatggtgtatatgcaccacattttctttattctgtctatcactgatggacatttggattgattccatgtctttgctattgtgaatagtgctgcagtgaatatatgtgtgcatgtatctttatattagaatgatatatattcctttgggtatacacccagtaatggaattgctgggccaaatggtatttctggttctagatctctagatctagaggaatcatcacactgtcttccacaatggttgaacaaatttacattcccaccaacagtgtaaaagtgttcctatttctccacagcctcaccagcatctgttgtttcttgactttttaataattaccattctgactggcgtgaggtggtgtcttattgtggttttggtgtgcatttctaatgatcagtgatgttgagctttttttcttgtgtttgttgaccacatacttgtcttcttttgagaagtgtcttttcatgtcctttttccactttttgatggggttgtttgttttttttcttggaaatttgtttaagtttcttgtagattctggatattagacctttgtctgatgggtagactgcaaaaattttctcccactctgtaggttgtctgctcactctgatgatagtttcttttgctgtgaagaagctctttagtttaattatatcccatttgtcaatttttgcttttgttgcaattacttttgatgtttttgtcgtgaaatctttgcccatgtctatgttctgaatggcaaagaatatctatctttaaaataatcttgagtgtgggaaagtgttcttaaacagaatataaaagccaaaatccataaagaaagaaatggaaagatctgacaaaatgaaaagtaaaagcttctttcagcattatgaaagacatcctaagcaaaattaaaaggcattttttgaggaaatattttttaacataaataatagacaaagttcatatctgcaatatataaagacctcctacaaataaataagaagccaccgtctgcccaaaaaaggataatatatatgagcaagaaattttttaaaagagatgttgtggccaggcgcagtggctcatgcctgtaatcctagcactttggcaggccaaggtggacagattgcctgagctcaggagtttgagaccagactgggcaacatggtgaaaccccatctctactaaaatacaaaaaaaaaaaaaaaacaaaaaaaaaaccaacaaaaaaaacacaaaataattagccgggcgtggcggtgtacacctgtagtcccagctactcaggaggctgaggcaattgcttgaacccgggaggcagaggttgcagtgagcggagatcgtgccgctgcactccagcctggtggcagagcgagactccttctcaaaaaaataaaaaaaataaaaaaaaaataaatgttgccaataatgtaggaaagatgttctcagcctttcttgcaatcaaagagagaattgtcaacatagagaataagctaacttgtaaaatgaaaaaggttgatagtatacacaattggcaagaggatgggggaaatgggtactcaagatatttgtggaaatgtaaatgttattttgaaaggcatttgggcagtaatttctcaacattttaaatgtgtatgctctttgatctagcaatttttcttttaggaatatatgctgcagaaatattaacacatgcacacaaaaaggtgcatgagaaggtttatgcaagacttatttttaataggaagaattggctatctatttgaataggaaaatcagaacccctatctatctcatatcatacataaaaataaattccagaaggatgaaagattctaaatataagaaaacaaaaccacacagacgtgtggtgaacactgaaggattgcttagatgtctctttggtgaaggactttctgtcccagtaagtcctttgaaacaagcatcccaaaagaggggacaactgtttaaaaatattgtgcattattaaatgctatagatatgctaaaaagagtgagcttgatctatgtgtattgtcatggaaggatatttgtgtcgtgatatattgctaacaaaagagaagttgtataaaaatgcataacacacatatgcatacatgcatgcattttataagtgcatagggacattctggaaagaaatgcacacgaggagagggaagttggttgtggtactgtagaaagacaacatttacttttactctagatacctctgaattatttaatacttttacatggaacttgcattacttttgtaattgaaacaatttaaaagagaaggaatgaaatgcactagaggaacaaacttgatgctttttctttgtttggcttcaccattattcatattactactaccactagagacagtcacttggaattttcttttgtccaaatgctgtataatgtattccatcgtattccatttttctgaaaatgatctaatttacatgatcaaatagcacttgattctcattcacacaaatgtcttgaaaaccaggtaagtgaagtgagctactgacatttatagaatataatctatatattaaaatttctggattcaagttcacaagattcattttattccccgcaaaggctgtggtcacctaaaagggaatgaaatatctaagaagggaatgagctctgaaaagtggaaagtagggtttcagaatatgagaacatccctgaggccatttcttcacagaataaagtggagtcaaaatttggaaatgccggtggtgaactggagatgtgccaacaactttgtgctgtgtaaaccaatttaaagaaagttagtgttgggaggtgaggtttacaccttcatcctttgctggctgatgctaagttaaatccttcaccctccactcccgcaaaaacccctgctcctttgaagttcttgccctctagctatgccaccatcagtttctcttcagctcccttacgtattgactttctcctcactatcttactttcagtgaagactttgatttctattcttcccaaattctgctgtcatctggagacttcggggtttgttcggataatccttccaacctcaggggtttccaaatcagtgtgcactggaaacgtgtaaaagtttttcaaagtgtgtatttctgagttttgcctactacatcagaatctctcaaggtgggggggccttagcttctggaatgtctaaaaccaccacagattatcattctaatacagtcagaaccgcgaatcacttgcagccttgctctttgtctgcctcaacctgtaactttgcattcaacttttctggctacgtagtagacattttcattaccgtagctgcccaacaggttcttccttccagctgctcagatagagtcgatttatcaagagagaggaattgcaataaagagtttaatacatatagagccagctaaatgggagactaaagttttattattactcaaatcgtttccccgaatattcagagcctagggtttttaaaaaatagttcagtgggcaggtggctagggaatgcgtgttgctgatcaattggggatgcaatcatagtggtgtggaaaatggtctgggtggaaccatccagttaccagaaatgcaaaagtctgaaaagacatctcaaaaggccaattttttgttctacaatagtgatgttatttacaggagtaactggggaagctgcaaatcttctgacctctggaataatggctggtaattgtttaactatgcctacatcttatcagaatccagggccctctcattctcctaacctggtggcctttcattagttttacaaaggcaggttagctctttgggaagggctactatcatttaaactataaactacatttctcctaaagttagctagtctcatgacaaggagtgaccaagggcagtttggaggttaaaggcaagatggagttggttagacagtaaaagatctcttttactgtcaacagttctctcattgttataatttttgcaaaggcagtttcatttcttgaaacctcaccacctatgaaatcttaaactccaagaatccattctctggttatgacctcaagttttccaactcactctcctcaattctactatagctagtcttcactgtagtgagatatccactaccttgaacagctccagttcttgtagactttttgtcccttactggcttctcaaagatcatgtaattttcccttctgctgtaccagtccagcataactccaaccctcaggtatacaaaattatctttactctctgcctttgcccagtctcatttattctctacattgcaggctgagtaacctttttaaatgcaaatttaaccacaggaacttcccccacccctccaaattgccttgcttaatcctttaaatggctccccatagttcttaggataaagtcccaattccacagtatgccatataaaatcagcaataatttttgccctgtgtgcatttgtttctgggctcagttcctacctctctctatttcaaaatctatgcttcatctacactgagatgctagtaccttcccccacactcatcatgatgtttcttatttatgagcatgtcctctctgtctggaatgccctcagccctctttgcaagcctagctcctatttatcctttaaagactcctctcaggaggcatctcctccctgatgaaatctcagaggtgacttagtttttaaaactcaaattctctaggcactttatatttggtacctagacccagggtgatattaaaatattgagcaatcagataccagtgcatgctggttgtgcatcaaacctgctcaggcaataaaatactgtaatatttaaagagtctctctcctttcctgtctcctctttccctcattggttccacttatcagcaaaaccctgggcaactgagctggggcagaatcagcagctgaaactttcattgtgtaccaataaaaatgtcattagaaaccttgaggcttaactttttccatcctcatgcgtcattgctaagggattccttcagaccacttctatatttctgcctgctccaccctggtaatcagtgccttacatacaatggtaggctctgggttagtaataatatcttttcaagaaaggtgactggtaagaatttctcagggacacacctaaataaaccaaaacccaaggtcaatatattacagtgacaaaaaggagatttgttggattgaaagaaaacaatcccaagttagagatgtgtttcactttctcttttttgatatgaatagtttctatatatagttgtcacacctatgaagaatgtaatttttagaggaccaggccatatttatctatttgccatgtttaagatagtgctagagatataatagttattcaataaatatttgttgactgactcaatgaatgaaaggatggatgtaccattctttagtagagatgagcaattattacttggtaaaagaaagcagaaactaagaaggatgttatacttctactaagaatacttctactaagaaaactacaacagttggagggagcaatttaaagttgagctgaaattctttagtattgttatctcaagtgccacaataaggaattcattcttttgtactgtgaaaactcacttgtgtgatacctagcatgtaatgccaaaccatttgcatgctgttcaaagaattgttctgcatatagattggtttgtgtacccatatgtataaaaattcaatttaaaggagcagcagaattagtcaatgagattgaagtttctcttcaacattcactgtagacgaaagaggtgcccatgcttatttgtatgtttaaggagggaagctggaggaggtatctgatgcatgtcttgcaaagaataaacaatattaacatttttcctgtgtatcattgttttctctcttgcttgctctctttactgcagatgttgtggctatttcttgatggttttcaggctccagttcattaagattactgcaattggtgcctctgctgaggatttcactactgtctttcaccagcaggtacacagcaacatgaatatgcttctaaatcacatttatgcttacttcaaaattataacagctggattatctgactctgtactgtcgctcttgtcaaataaataaattaacccctaaatctcttctagagcaaagccaaaatcagtgttcctgtaaactttccaaagttaaaatacaggggtttttctcctgtattgttttaagcagggtaaaaatactgaatttaaaatattggaaaaatattagatagactcaaccatgaaataaaactgttttatatttccccatagctatcttttcacatgcagggtaggtctctcttcattgattggtttccttttattacatagtgttctgggagaagcaaagtaatcttgagcaccataagtgtaaccacccaaggggttcaccttgcccgctgcctagacagagccaattcatcaagacaagggaattgcagtcaagaaagagtaattcacgcagagccagctgtgtgggagatcggagttttattattactcaaatcagtctccccgagtattgggggagcagagtttttaaggataacttggtgggtggggggaagccagtgagtcaggagtgctgattggtcagagatgaaatcatagggagtcggagctgtcttcttgcctctgagtcagttcctgggtggggccataagatcagatgagccagttcattgatctgggtggtgccagctgatccatcaagtgcagggtctgcacaatttctcaagcagtgatcttaggagcagtttagggagggtcagaatcttgtagcctccagctgcatgacttctaaaccatcatttctaatcttgtggttactgttagtcctacaaaggcaacctagtcccaggcaggaaggaggtctgctttgggaaagggctgttaccgtctttgtttaaactaagtttctcccaaagttagttcagactacgcccaggaatgaacaaggccagcttggaggctagaagcaagatggagtcagttaagttagaacactttcactgtctcagtcataattttgcaaaggcgatttcataagggtcaaagaaactgtgaacttgtggattaaacttgcaaaaatgctttcttgatgaggactgtttgtctttcttgtcttctgatatatatcaatttgcaaattaaaatagaatctttaaggcctctctgatttctgtttgaatttgaaatgggatacagctcccagattcctttatctgacattctaactcataggggtactgctcaaagctgccagaacatgtttttcattccgtaagtgtcaactgagcccttaatcctcttcaagttggttaaataagttagtgcgggaagttgtgtcatgagaaggaatcccacagacttggaactaaaaagatttagggggaattagttaggtcctcttgagataaggcagggttgctttatctaactggtcactccttttacatgactgatagaggatgaaaaaaatgtctctgaacttctcaatctagatttatttttgcagcttaactcagccttggctcatgtgcctgcccatctccattattagagtcaaagaagggtttttggtgtgtgaattttcctctggaatcagatagagaaagataagcagatgaatagagctttgcatttacatgacaacagaagagcaaaagacaaatggcgccagacatggtgactcatgcctataatcccagcactttgggaggccaaggctggtggatcacctgaggtcaggggttcgagaccaacctggccaacctaatgaaaacccgtctccactaaacatacaaaaattaactgagtgtggtggcacacacctgtaattccagctactcaggaggctgaggcaggagagtcacttgaaccggggaggcagaaattgctgtgagccgagatcatgccattgcactccagcctgagtaacagagcaagactttgtctcagaaaaagaaaaagaaaaaaaaaaaagacaaatagaaagaaaagacaccctgtgcaattgtgtctttctttcaacaatttgtcgacacatgtgtttggattgtactcatcattggtttatattggacaaagaataaccctatcagttcctgtgttgaaaagagggcaaattcatgtgaactggagcaatctttacatggaataagtgcaaaaggagaccttggctacttatgatacagaatcttctaccttgagggtcagcatactggggtctgcctgttctggtaaataaagtttcattggaacacagccacattcattcatttatatgttgtttatagctgcttctaagtagttgtgacagcagttgtatgactcacaaagcttaacataattactgtctggcccttgacagaaaaagttttccaaccctgttctacccaacacagatcaggaagagatgccatggtcctgagaggtggtcaatagatatgatcactttttgggaaacatttatagtttaaagtttaaaaatgttagttgcagacaattatttagaaattatagcagtatatcagttaattgatttgataaaattaatatatatactgtttatcaatataaataatttacattatggacttgttttattgtattattcagactttgtagtcactggaaaggtatagaaacgaaggcgctatctaaaatgatagtaataattcatatcagtcaatagcattgattaggcactcatgtggtacagaactctattccaggcccaggaggaagaagggaagagcccaaaagaaacagatgctgttataactgaggatcctactaaatggtctaattaagaagctgttgtatattcctgcagtgattccagaaaactcataaagtaatataaacccatgaaagcaaatgaaaagagctcagaatctaggacagaaagataagggatgaattccctgtatgtcagtcacctagatgcttcttcaggccttcatcctgtggatttgccctgattcttttggttgttcaggaatttgtttaaacatagatttcatactttggcttttgactttcatcttgctgatttttgcccattgataagtatattgagattattttggaacttgtatctgaagttgaatgtaaagacattttattctgacatttcctgaaaaatatatgcgtgacttgtttgtcttcatccaagtgatagaggcacaagaatcctagaggtagctgtgaccttagaggcgatctacagcaaagctttctcaaacattaattttcatctggataacctggggatcttattaaaatgcagattctaattcaataggtctggagtggatcctgagaagtctgcagatgagactttgaagagcaaggtgctagaggatcagctggtaagaatttgttctgcaatatctctgaagattttcactagcttcattgtgaatactgttaaggtacacaaagaactcacaaccttcaaggcaacctggttcatcatggagaattttaatgcttagaatatctttatgtcgtcaatattataccttgcgaagttttttttttttgtttgtttgttttgagatggagttttgctcttgtcacccaggctggagtgcaatggtgcaatctcggcccactgcaacttcagcctcccaggttcaagcaattctcctgcctcagccttccgagtagttggaattacaagtgtgcaccaccatgcctggctaatttttatatttttagtagagacagggtttccccacattggccaggctggtctcaaactcctgacctcaggtgatctgcctgcctcggcctcccaaagtgctgggattacaggcatgagccaccatgcccgaccgtgaagttttttacgatgagttcaatttcttgtaaatttaataatggttgctattgaattgccacttttgagattatcagccaattctttcttcttggccaaatttaagccctctaggagactctgtattataagtgggttgttgtccaagggaagtaactagtgatgagagattggatttggagcttcacttagttgctggctgactacttcgctttccctatatgcttccttttctttctccttctctccagtcttctgaactgaacacacatcatacgtacagtttatcatatgtacacacatcaataccaattggaggtattcaagccccaggatagtatgccatctgacctcagtggtgtgctggtaaatgattaacaactgtttttgggggtgagggtgtggaatggtaacacattactattaaagttaaatgcttgccaatttccatggtgtaaatacccctaccatcgcttatttctaactaaaattcctaaaaatttaatagccagtaagaatctccagcacagctccatctgacccctcatagtaaataacagttaacaattatagagcacttactatgtaagaggcaatatgttacacattgtacatctggcctctaacaaaattaaaatgagaccctatttattcattcaacaagtcacagaatttccttcatggtaggtgccagagaaataaagatgaatgggaatcaacctctgccctcaacctattcatggagtctagtgggagagacagatacataaataaattacagtgcaacataataaataatgggacagatggtgaaggtaactgatttagtacccattttggtccctgctgggggtaagggaagtggaagagaggccattttctttaccttcttgcaaaagcccatgcttaccatgtcaaaatatcttttgtgaatacattttatgtagatattctttatatctaagggaattgaagagcatatcagtttctttaaaaagaaaatttttgacatgcatgttacgtcttggaattgggtctaaattatctgtcatataggcttctgaaagagaatatggaatacagagaagaaaccttttgagaagtgacaatttgcagacctcaggagtactatccttattcaaattcaatttcattttagaaagcttgaaggcattggactattacagagataaaaagccaagtattaatcttttgagttagtatcttattcaagatgttgaacctgagaagagtttgcagaactctaattcttttaaaactaaagatcaagcaaaaaaagttttaagaaatggtgacttgatggctacttcttatttgattgttgctaacaattaatgtaatttattacaaccactgactgcttatttattttattgcctgaagtccttatggaagtaggatgggccaaaataataaaatactattttattttgcttccaagcttctttgcctcagtactctatttgtctgtcacttttctactggcttacacaggccagaattatattttagcattgtgatcggagtgtgaaaacagggtttggggtatatcaaaaaccaatcttgatgtgccagaatggtgtgccagaaaacaaggttgttatgcttctttctcttctatctgtcctatgtggacctagcatgagtgatgtgattatttagtgcagaattcttgatatttcgcgaggaaccctactaagcaagcttgctttggtttctcacaggattaaggaagacagaataaagaatgatgctttgaaaagagaacagtgagggacctaggaaccagtcacaacctcctaattccctgcaaggccttggggatgctgtgctgaaatttttaaatacaaaacggctgtaaaggtttacattttaccgagttagtatgaaggggaaaaaaggtaaatgggaaaactcaataattgatgatcaagttcattaattggatatatttctatattattaaatgatttacttttatgtttattttacatagcttttcatttggttttacttttctataggcctttgtagatgaacaagtctctctggactgttacccaaaagaggaatttattgacattttaatgttggcttttttttttctgccgagtaatagtcaaatggggaagctactacaagttaggatgaccaacaaatttaccattcaaaccaggacattcttgagaatgaaaggaggtgctgttattaatatactataataattattctggtagattaggaataaacagactgtcaattagcaaactggaatgtatggccatcctaactgtgggtcgtttaatcactgccatttggttgccattggatttctgttttttttttcttaagctccaacagaataaatgccatgggatttcattgaaacatctgaaaaacatgaagccatgcagtttttacaaaattgcctgggattcgcatatgttcctatcgtggaaattagaatagggtcaagaaatagtaattctctcccttatgactgaaacaagagagtgagaagaaggcttccaaagttagatgatcctttttctaggtcattacttccctgagcttatgtacctgcattccacagggctcagaaagctttcgctactctatattcctgttacaaatgttgcctgagcccagatttttctcatatctcacctgggctatagcaaaaatcttcttactgatctccctgcctatagtctttctacatgtcaaatcctttctccatatcataggcagattggtttatctaaaatgtaaagctgaccatatcactctctatttcaacattttccagcagctcctgttccctacagtacaagatcaaaatcactttgcagggcacacaagaccccccataaatttattcctgtctaattcttcagcatcactctttagcaacaataaattgtttcaatttctccatacacaccatgctatcttttacttttattcatttttgaacttatcttcacatgtagaaaactgtgcaaagggagtcttcccccacaggaggaaggatagtgtttgactctgagaatatctgaattcatcacttgtcatttatcttttatttacatacagcaaaattcactgcttttggtgactattctataagttttggcaaatatacacagttatgtaaccacaaccactacaatcaagttccagtttcatcactctcctctcttcccgcaaaatgatcttgtttgttacctttgtaatcaagcctttattccctggcaatcaccaatctgttctgtacccttataattttgccttttatagaatatcatgtaaatggaatgatgcaatatatatgtattactcagcataatggagactcatccttgttgttgcatgtatcagtatttcattcctttttattgttgagtaaatgttccattggatggatgtaccatattctgtttatccattcctctgttaaggaacatttgggttgtttccagttatgggtaactatgaataaagctgctatgaacattttcaaacagattttcctgtgaacacaggtttttattctgcttagacagaagcccaggagtgggatgactgggttgtatggtaagcgtatgtttataagaaaactgccaaactattttccaaagtggctgtactgttttgcattcccacaaccaatatatgagggtttctgttcctccacatcctcaacaaaatttgatatggccagtaattttaatgtaagccatcctattaggtgtgtgtagtataatttcattgcggttttcatttgcgtttttataatgactaattacacagagcatcttttcatatgcttttatgctgtctgtttatcttctttgaagtgtctgatcaaatattttacccatgtctttattggatttttagtgttctcattgttaagttttgagaattctttatatatttttaatgaaattattttgtcagaaatatgatttgcatatattttttcccattctgcggcttcttttctattctcttaacagtgtcttttgtagagcaaacattttcaattttgattaagtttatgaattgtttcttttaagcatcaggcttttgctgtcatatataaaagttgtctgtctaacccaaggggtattagtttgctaggggtgttatataccacagacgggggtgcttaaacaacagaaatttattttctcacagtctggaggctagaagtccaagatcaagatgtcagcaggtttggtttctcctcaggtctctcttcttggcttctcttctcactgtgtcccacatggtcttccttttgttagtgcatcttcgtgtttgtgtattagtcagtgtttcttagagaaacacaactaataggataaatatttatatataatgtataatatatatatatatatatatatatatatatatatatatatatataatgtatgatttattatgaggagttggctcatgcaattatggaggctaagtcccacaacctgcagtctgcaaactggaaagccattggtgtagttcagtccaagtccgaagatctgaaaaccagggaaactgatggtgtaagtctcagtcgaagggtggaagaagactgatgttccaactaaataggcagaaggagcaaattctcccttccttcaacttttgttcttaaaagattggatgatgcccacccatattgaagaaagtaatcttctttaccgagcccaccaattcaaatgctaatctcatccagagacaccctcacagacacacccagaaataatatttagctaaatatctgagtaccccgtgatccagttgatacatacaattaaccatcacagtcctaattttctcttcacactcttcttaaaagggtaccagtcatattggattaggccccatgcatatgacatcattttaccttaatttgctctttaaagaccctatctccaaataaagtcacattctgaggtactgggggttaagacttcaatgtatgaattgaagggttgtcacaatttaactcatgacacaggtcaaagattttcttttatgttttctgctaaatgtaaattattttagtagagaaattgtaaagttattggtgaggacagagactgatttgctgaatgctgtactgcgaatgcctagcacaatgcttggtatacaaaaatcctcaccaaaagcttgttgaatgaatgagtgaatgaatgtggatctcattcattattccatttatgctcttcgaatctcaaaaaacgcttgtagctgccctgctggaggacctttattgtatttaatgattcaaattattgcctgataacttaacaagaactattcaaaattgccccaaatggaaatatctactaaagacaaacatgagcttactctatgactcatcagtttcattcccgggtatataccctacagattcgtatgtatgttcaccaagacacaaatacaagaatgttcaaaacaacaccacctataaaagacaaaactggatgcatccagaatgctcatcaacagaaaaattgatacattttgacatattcacaaaatgtgacactagacagaaatgatactatggtttggatgtcctctccaaaactcatgtttgaaatttagtttccatggtgacagtattacgaggtgagactattaagaggtaattaggccataaggtgcctaccttcataaatggattaatactattattgcaggagtgggttagttattgagagggtgggcttttggtaaaacgatgaagttcaacccccatcttttctctgttttatgtgctcatttgcccttccaccttccgccataggatgacacagcacaaagacctttgccagatgccagcatcttgatatgaactgtcctaacctccagaactgtgagaaataaatttattttctttataaattacccagtctgtaggattctgttacagcaacaggaaacaagctaagaaaaataacaataaatgtattacttatatatgcaacaacatgaatgtatcttaaaacattgatcaagcacagataaaaagaacacaaatttcattacttcatttatgtaaagctaaaaaacaggcaaaacttacctatggttatagaactcatgacagttgttacctttagggaagagggaatttggagagaatattagggggcttctgtggtgctggtaatgttctatttatttacatgggtggtaggtacatgtaggttcactttgtaaaatataattgaactctgatttattatttgagtttacttttaaaaaattatgccatatggacatgaccttgttgtttctgtacaaactgtgagaagacctgggaaggtattttactgagctttattaaaaaacaaagcaaaatagaatatagattattttcctattataaaatgttatctgtttctttttcccttctaagtttttttttttacatgtgttcaacatcaaacttcgttggctgtgtgcatacaaatcgggaaaaggaaaagtatcagcacaaaaagggaaagctcctcttggggaagttctgaggaaacactaggatctggtcaagcttatatggtcttatcttttgagtgcccatagcctagtcacaagtggcaattcaggttatcacacaaagttgaatttgtcataccagctgcctttcttattaacagtaaagccactgaactgtatactttttcactgttgatctatttgtcatttgcactcaaatttcactagtggggaaatttctttataaacaggtgctcagcatcatgtttctgaaatgttaagatatgttgtgcaaattgctacccacctagagaggtggtacatgctaatttaaagttgcctattataaagtcattatttcttggtactcttagggcacaagtggaagtgataacttttgaaaaatgaggttgttggccgggcgcggtggctcacgcctgtaatcccagcactatgggaggccgaggcgggcggatcacgagatcaggagatcgagaccatcctggctaacacagtgaagccccttctctactaaaaatacaaaaaagccgggcgtggtggtgggtgcctgtagtcccagctactcaggaggctgaggcaagagaatggcgtgaacccgggaggtagagcttgcagtgagccgagatcgcgtcactgcactccagcctgggtgacagagcgagactccgtcttaaaaaaaaaaaaaaaaaagaaaagaaaaataaggttgttgaacatcaagagatgccctgtgtgatgtgtgtgtgtgtgtgtgtgtgtgtgtgtgtgtgtgcatgttttgaaagacaagagcattaaaattaatgtctgttctaggagttcctcactttgatggatatatctggagcaattaaggagatttgttctccttaatcgaaatttttactcaattatccttttaaattaatccaaagttttacaagaaagacaggaaaatataaaatgctgatgaatagtatcattttcttttcttttttcttttttttttgagacggagccttgctctgtcgcccaggctggagtgcagtggcgtaatctcagcttactgcaacctccgcctcccaggttcaagcgattctcctgcctcagcctcccgagtagctgggattacagacaccccaccagcatgcctggctaatttttgtatttttttagtagaaacggggttgcaccatgttggccaggttggtctcgagctcctgacctcaggagatctgcctgcctcggcctcccaaagtgttgggattacaggcgtgaaccaccgtgcccggccccattttcttatcagtatgctttatcatatattgtaatctactttccaaatgcccatatgaaattatctctgggatgatctaatcagtattttagcagttggctgtttctgtggctattggagaaaaaaaatcaaagatggacttgatgttctgtgatggtatgccaataagtgaacatgaaaaaagtccaatagtcaacttgctatcaaactacctagtgactacattgagcccataagttccttttagactcttttcaaatacagaacttccagtaatgacgacaaagtgaagtggttgtgtgaaactttgtacagttaataattataaaatccaggaaaaaaaaatcccaacagtttaatttactggaaggtatctaagagcagacagaacagaagaaagagaaaagcttactcttgaaaagctgcaattagagggggaagaactgcaaatttgtgactttcttttctgaggatttcccctctctccatggctacagcagaaaaaaaaaaattcacagcattatgacagcaggaaaaaatccaaagctggaaatgcaggtatagatttaaggagggaaattttggaagcaaaggagtgaaacacaaaatctgagcactaactctaccctaaagctggctgattgttaaactatgcatatgtaggggagataccagggcatctgttggaaaaaacaggcaaggcacagagaggaatttaccccagaaaagcagctgcactaggtgagatctgtgttttctgttttaaaaaaaaaaatccaagtgtgtttcccaacctatgcaggtggctgaatactgaagttttactggcttgatgtgtcagaggacagcagagaaatttagggaaaaaattccataagcaacagaactaaacagagggcgaaccccaatatctgagcgtaagctatgccgaagtccttggctgaccaacaagatattcaggtgcaggtgaactcccaggaagccagggtaaaaatagtagcatcaagaaactgtaagaactgagcaaatatatcagctgctgtacaccacaggagagacagagtttgccatttgaattcatacaatttacctatagagcaacaaaaaaaccatcctcagaacacaatataatccagaatcaccagaatgtatctataatgtccaattttagcacaaaattatagatatgcaaagaaacatgaaagtcttacccacattcaggaaaaagctattcaatagaaaacaaatgcatcagaatggttctaaatgttgggtatagctgacaaggtttcaaaggtggcactataaatgtatgcatagagttaaaaagagaaatgaaattagtgggtgaacagagaaagaatctctgagagaaatgaaaaacattttaaaaatgaaaattcaagaattcaaaagtacaatactggaaatgaaaattcaccagataggctcaagagcaggttggagatgaagaaaaataatagtgaacttgaagacagatcaattaaaattatacaactcaaagaagagagagaaaatcatagaagaaaagtaggtggagactgacttttgagacaaaatcaagaagagaagagatactttaaaatgtaatttagtaagaattaatttaaattaatttaattaattttaatgtaattgttttaaatgtaagtggactaaatatttctattaaaaggcagacatattgtgagactggatacaagaaagaactatgtactgttcagaggagacacactttaaatagaaggatataagtaggttgaaagataaaggatggaaaattatatataaatcaaactgtaagtataagaaaactggtgtggttaatttaatgaagtagatttctagacaagatgcattattagcttcaaaaaagaaaacttcataattataaaagtgttagtatatcatgaagatataacaattataaacatataggcaccttgtattaaagcttcaaaatacagtaaatgaaaactggtagaggcaaaaagagaaataaatgcacaaacatttagaagtttcaacatacctctttcaataattggtagaacaactggactaaaaataagtaaatataaggaagatctaagtgtccattttaattaccttaacttaattaggactcatggaacatttccctcaacaatagtgcaattcccatatttttcaagtgcctatggaacattcaccaagctaagccatatactatgacatacattagtcttaacaaatttttaaaaattgaaatcatatacagtgtctttcccaccatgaaaaaattaaattagaaatcaacaatatgacatcttacaaattctcaaatatttggatactaaaaattgacttctaaataacccacagatcaattagaaatttgaaaatgttgtatgctgaataataatgaaaacatatcattgcaaaatttatgggatacagctaatatagtgctcagaggaaagcttaaaatgtttgcattagaaaataaggaaaccctaatatcaatacaattttattctactttctaaagctaaaatatgcagaaaaatttaaaccaaagtaagtaaaagtgcacaaatattaaagatgatagatgttttaatgaaatggaaaatggataagcaatagagaaaaatcaataaaaccaaagtttggtttgttgacaaggtccaaaaaattggtacatgtctagttagactgatttaagaaaaaaaagaaaagatacaaagtatattttctttggaatgaaaaggggcatcaccatagacctttcagactgtaaaataataatatgagaatgttataataaattaatgccaatacatttgacaacttaggagatatggaaaaacatattaaaaggcacaaatgatcaaaattgatgtaagaagaaatataaaaatccaagtagccacatctactgaaaaaattgaatttgcaagcaaaagtcttcctacaaagaaaactccaaacctagatggttacatggatgaattctctcaaacaagtaaggaataaataacatcaatcctttaaggtaggtcagctgagattatccagtctaaggaacagaaagaaaaacaaatgaagaaaaaagaccaaaacctcagagacctgtgagacatcaaatgtaacaacagatgcaaaatggaagtcccagaaaaagaggagaaaaagagaacagttagaaagaacttctgaataaataatggctaaattttttttttgtaattgatggaaaactttaatctcacatgcaagaagctcaatgaattccaattaagataaactgaaagcaatccacacatcataatcaaactgtcaaaagccaaagacagagcccacgaaagcagcaagagagaaggcaactaatcaaggtatcttcaataagattgatagatcagaaaccatggaggccagaggccttgggatgaaatattcaaagtgctaatagaaaaaaaaaaatatgccaaccaagaactctatgttcagcaaaactatctttcaaaaatgaaggagaaagtaagacagtcctagataagcacaaactgagagaagtcatcactagcaaacttgccctacaagagctaaaatgagaactcttcatgctgaaataaaataaaactagagagtaacttgtattcacatgaagaaatgaagaggactggtaaagataaatacagaggtaaatattgaagagtataaatatatattttgcttggatctctttcttttcacctttctgattataaaaacaatataatgcagtaattcgaaatctgtattaatgggcacacaatgaataaaatataatttctatgacaatagcagcacaaaggttgggggaaggataggatctatgtaagagcagagttttttgtatactattgaaattaagttggtattaatctgagctagattgctgtatgttaagatgttaattgtgggtgggcgtggtggctcacgcctgtaatcccagcactttgggaggccgaggtgggcggatcacctgaggtcaggggtttgagaccagcctgaccaacatggagaaaccccatgtccactaaaactacaaaattagccgggtgtggtgacacatgcctgtaatcccagctactcaggaggctgaggcaggagaatcgcttgaacccgggaggcgaggttgcagtgagccgagatcacgccattgcactccagcctgggcaacaagagtgaaactccgtctcaaaaaaaaaaaaaaaaaaaaagatgttaattgtaatacctatggcaaccacaaagaaaatgactcaaaaaatatagtaaaagaaacaataaaggagtaaatatgatacacagtaaagtgtttacttcgcactaaaaaacataataatggaggaattaaggaacaaaatgacaggacatatagaaaacaaacagcaaaatagcagatgtaaatactatcttatcagtagccatattaaatgtaaatggattaataactccaactaaaatatacagagataggcagaatggataaaaaacgatgcaactatattctgtctatagggggtacacttcatattcagacatatataggctgaaagtaaaaggatgaaaaaatatatatcatggaaacagtaaacaagagcaaacaggagcaggtatattaatatcagacaaaatagactttaagacaaaattgttattagagatcatgaagattttagttcatgattttagttactaaaatgtcaatccatccagaaaacaacataattattgaaatgcaggtgcctaacaacggagcccaaaaatacattgacttcaacattcaagtcttattatttgagcaaaaaaaaaaaacagattaagttgaagagacatataggcaattcagcaataattattggagacttcaatgctcaactttccataatggatagagcaactaaagaatagtaacgaactagagacttaaacaacactgtaaaccaactagactctgtggagcggaatatagtaacagtggaatatatattctttttcagctcacatggaacagtctccaggacagaccacataataggccacaaaacaagccttaatcaattttgagagattgaaattatacaaagtgtgttctctcccacaatagaatgaaattagaaatcaatagcaaaggaaatttggaaaatttacaaatatgtgaagttaaaaaacacatgccttaatcaccaatgggtcaaagaatacatcacaaaggaaattagaaaatattttaaaatgaatgaaaataaaatacaggcacatcttattttattacatttcattttattgtgttttacagatactgcttttttttttttaacaacttgaaggtgtgtgtctctgtttaacattttggtaattctcaaaatatttcaaactatttcattattattatatctgttatggtgatctgtgatcagtaatctttgatgttactatggtaattgttttgaggcaccacaaactcctcccatctaagacaaaaaacttaatcgataaatgtgggtgttctgctccactgaccagctgtttctctttctctcttcctctctttggtccttcctattccctgagacacaacgatattgaaattagaccaattaattaccataaaatgacctccaagtgtccaagtgaaaggacgagttgcacatctctcactttaaatcaaaagctagaaatgattaagcttagtgacaaaggcacacaaagcccataaagactgaaagctaggcttcttacaccagttaggcaagttgtgaatgcaaaggaaaagttcttgaaggaaattaaaagtgctactccagctgaaacatgtatgataagaaagtgaaaacaatcttattgatgatatgaaggttttagtggtctagatagaagatcaaaccagctacaatacccttaagccaaagctgattccagagaaaggccctagcgctcttcaattttatgaaggctgagagaggcaaagaagctgcagaagaaaatttgaagctagcagaggtttaaggaaatcagccctcttcacagcataaaattgcaaaatgaagcaacaagtgccagtgcagaagctgcaccaagttatccagaagatctagataagatcattgatggtgactacactaagcaacacgtttctgttatagacaaaacagccttattttggaagaacatgctatctaggactttcatcgctagacagaagtaaatgcctggctccaaagcttcaaaggacaggctgactctcttgttaggggctaatgtagctggtgactttaagttgaagccaatgtccacttgccaatctgaaaatcctagggctctcaagaaatatgctaagtctactctgcctgtgctcttgaaatgaaaccacaaagcttgaatgacagcacatctgtttacagcatgatttaccaaatattgaaagtgtgctgttgagacctactgctcagaaaaaaagattcccttcaaaatattactactcattgacaatataactggttactcagggcctctgatggagatgtacaaggagattaatgctgttttcatgcttgccaactaaatatccatcctgtagcccactgatcaataagtgatttcaatgttcgagtcttattatttaagaaatacgtttcaagaggttgtagctgccattgatagtgattcctctgatgcatctgggcaaagtaaattgaaaaccttctggaaagaattcaccattctagatgccattaagagcatttgtgattcaggggaggaggtcaaaatagcaacatttacaggaattcaagacgtggattccaaccttcatgaataactttggagggattcaagacttcggcagaggtaataactgctgatgtcatagaaataacaagaggagtagaataatgagtggaacctaaagatgtgaccgaattgctgcaatctcatgataaatttgaaagagatgaggaattgcttcttatgaatgagcaaaggaagtgatttcttgagacggaatttacttctggtgaagatgctgtgaacgttgttgaaatgacagtaaaagatttagaatattaagccaggcacagtggctcacgcctgtaatcccagcattttgggaggccgaggtaggcggatcacgaggtcaggagattgagaccatcctggctaacatggtgaaaccccgtctctactgaaaatacaaaaaattagccaggcttggtggagggtgcctgcagtcccagctactcgggaggctgaggcaggagaatggcatgaacccgggaggcggagcttgcagtgagccgaattggtgccactgtactccagcctgggcgacagagccagactccgtctcaaaaaaaaaaaaagatatagaacattatgtaatgtaaacttagctcataaagtagtgtcagggattgagaggactgactccaattttgaaagaagttctcctgtgggtaaaatgctatcaaatggcattgcatgcttcggaaaagtcttttgtaaaaggaagagtcaatcaatgccacaaacatcattgttgtctaatttaaaaaactgtcacagcaccccaaccttcagcaaccaccatcatgatcagttagcatccatcaacatcaaggcaagaccctacaccagcaaaaagattatgaattgctgaacgcgtggatgatcgttagcatttttcagacaataaaatactttcaaattaaaatatgtaattttctttagatataatgctattgcacacttaatagactataagggccacagggacatttgccagtataaacaaatttcctatatgaggaactcctagtcttgggatggacatctaggcactaggcctttcaccaggtaaaagaagtatccttgggccaggcgcaatggctcatgcctgtaatcctagcactttgggaggccgaagccagtggattacctgaggtcaaaagttcgagaccagcctggccaacatggagaaaccctgtctctactaaaaatacaaaaattagccaggcatggtggtgcgcacctgtaatcccagctactcgggaggctgagacaggagaatcgcttgaacccaggaggcagaggttgcagtgagccaagatcgcaccactgtactccagcctggataacagagcaagactccatctcaaaaaaaaaaaaaaaaaaaaaaaagaagaagtattctctgcaaggcacactgtaaacactcatggtctgctcccctttcttttctgttagcacaggactgctagctgctctggtactggaatcccaatttagctgagggctctcacaacagcatgatataaagttaatatataaaaatcaattgtgtttctatatggttgcaacaaatggttggataataaaataaaaatatagtttattttaaaatagcatcaaaaccatgaaatactttgggataaatttaacaaaagattatatggctactgaaaactttaaaacaattttaaagaaattaaaaaatacctaaatgaaatgaaaaagtacctaaatgacttaacattcaaatatgggtaagttcaatattactaagatgctaattttccccaagttgatgtatagattcaacccaattccaatctaacttttagcaagatgctttatacaaattcatacaagttaattctaaaatttataagaaaatacaatggcttaaaaggatcaaacaattttaaaaagaataaagttgggcgacttatgccacctgatttcagaacttataaagctacagtaaagaagataatattgtttttgtgaatggattgacatgtatattagtaaacagaaacagcccagaaatagagtcagtcatatatagcctattgatttgtaacagaggtggcaaggtaattcaatggtggaaagaaaagtcatttcaacaaactgtgctgaaacaactgcttatctgtatggaaaaaacccgaatatttactgctacctaaaaccatactgaaaaatctaaacaaaccatacaattaaatgtaagagttaaaagtatacaaattctagaagaaaatgtagaagacatcagagtaggcaaaattttcttagaaaagaagcataaaccacacaaaaacagagaccttggaaaatgtcaaaagctttactctttgaaagctatcatttagaaatgaaaaggtaagccacagagtagaaaacaataatcacaaaacatgtcagacaaatggctttcatccagaaaatataaataactcttataactcaatgataagaggaaattttaatataaaatgagaaaaatgtctgaatagacacttcacaaaagaatatataccagtggcccaaaacacataaagagatgcccaacatctttagttatcaggaggaacatgcaaattaaaatgacaatgagatattactatatccccagcaaaaaggctaaaaataaaattgcaatactaaatattggagagaatgccagagtacctgaaattctcatgtactgctggtgagaatataaaattgtacaaatatttggtagtttgacagtttgttttaaagttaagcagtcacctttcatacctcctatctagtccattcctagatatttattcaaagaaacaaaaatgtttattcacattaagacttctatataaatgtttatagtagctttattaattgtaaaaacaagaagcaacccagatatacctgaacttggaaacggataaacaatcttaggtatatccacacaatgctatacataatgaccaacaagagagaatgagctattaacacctgcaacaatatgggtgaatcttcaacacatgctaagtaaaagaagccatacataaaacagtgcatatattatgtttttatttatattaaattctggaaaatacaaactgatccctattgatagaaagcatatagggtggttgcccgggtttggggtggaaatggtaatgaactataagggagtatgagggaacttttttttaggggtcaaagaaatgtttttttatcttgatcatagtagtggttgcacaggtgtatatatttgtgagtacctcctaaaactgtacacttaaaatgagtaagtttattatatgcacattatatctcaataaaattgctcaaaaatgaaaaaatactgtatgattgaaatagctatttttatctgatcaactgataatgagcatattattagggtagttgttttcatgtgcccaacatccttttgctcttcttttaataacaacagcttcatattcctttaggtaactaccctccagcaacactttcaatctttgtcattttaattggacagattccatcttccagattacagatttgggaaatgtgatcctgtgggcctggtaaatcagagtcaaggtaattaggtcagcatgtgcctgtgacccaaggatgcgataactaccaaaattttgctggggctgttgggaacaggtaattctttttcctcctggtagactgtgaaagcacatctgagtcattagaagaaattgagttctgatgatattttcggaagccctgaatctagctatgcttgaagtaacacacctgttgcaagatactctagttatttgggccaatcaatttatttctttgcttaaatttatttttaaatgtgttgctgtcattttcaatagttaatacaaaaatgaaatcagttctatgagttttgacatttgttacagttgtaaattgtcagattttgtagagatgacctaaattgtattgacaaaataatctctgctcccgcaacctggcagctatgatgtacatgaggaatttataagcctacaagaaaaatagggttggggaaccatggtgatctataaaagcaattatgaatatttttaaatgtataaaaataaatttatcagtatactaatgactatattagtggtaatttatactgtgtagtaaagaattttcccttgcctgaagaggtctggccttcgttcctgtctcctggggaggtaacctttaaacccttgcagttccttaaagtgatatgagtatgtttgttattcatggtggggccctcagatcacacttgatagtttatgcaaatgaggtgactcatcatgggtccattagaccatgtggtatcagtctgatctccaggaagttgctggaaattgagttcaaccacatgggcaaccaaccaatgaattatgcctatataacgaaatcctaataaaaactctggacaccaaaatttgccaggcatggtggcacatgtctgtaatcccagctacttgggaggctgaggcagcagaatcgcttgaacccaggagtgggaggttgcagtgagccaagttagggccactgcactccagcctgggtgacagagcaagactccgtctctaaaaaacaaaataggccgggtgcggtggctcacgcctgtaatcccagcactttgggaggccaaggcgggggtggatcacctgagaccaggagttcaagaccagcctggccaacatggtgaaaccctgtctctactaaaaaagtacaaaaattagctgggcgtggtagcaggtgcctgtaatcccatctactcaggaggctgaggcaggagaattgcttgaacccgggaggtggaggttgcagtgagctgagatcgcgccactgcactccagctgggcaacaagagcaagactctgtctcaaagaaaaaaaaaaaattctggacaccaatgctcaggtgagctttcctggttggaaacacttggtgtgtattatcacacatctacactgggagggtaatgcctactgactacaatggaagctttgtgtttaggacggtctcatactctgcactatgtgtttcttcctttgtgtctgtactcttttcccttaaaaactgtaactgtgagtataatagctttcagtgagttctaagagtccttattgtgaattatcaaacctaaagatggttttgggaaacccctgaacatgcagctgatgtcagaagtaacgacagtcttggggaccgtgccctctaactttgtagttatacactaaatccttgaagttggtgtcagaaatcttgggcagaataggcagtctgaaggcttgggccctcaaacctcatggtttgtctaactctgggtatacacacttaatagtaaatggttctgtacagttaatttaaatttattattacttacttcctggacatgaaggattaccttcctcagaggtgaatttaccatgaagctaatgtagcttatgcttcaaggcccctcatttgcaggagcaccttctaaggcttgagtgtttacatgacaacgtgttcacatggtcatatgtttttgtaaaatttgtaaaacttgcaaaagtaggatatttaacctcatttggttcaggctaccgtgcattttgtgtctagttttatatttataattttgtgttcttttcttaaaagagagccttccaaacttcaggccaataaaatttgatccatccctggtcttctctcaaaattatcagacaatggcaaattcattttgctctgttgtggataatatgcctactaagtgacaatttgatgtgtgtgtgtgtgtatgtgtttccctccatactgaaaagtacttttctgattttaagactctaaatatcagtgtagtgcctttctattttcagatagcatcatgattccagaaaacatttcatgtgtctcagtccttttcttgctaatggatgcaactccaaggtcagggttcatgttctttcttttatggctgtattgtaaaaccattactcttcctcacctatttgccaatctttcctcaaccatttgccttttttttctcttatcaaattcccttctttttaaactacctccaacagaagtaacccatataactaaaaccaaattcttgtggctgtagaaattatgccaaagtaaattcttgcatggtagaatttcacttaaggaaagtttgtggttggtgaaggtctgtattatctctctctctctctctctctctctctctctctctctctctctctctctctctctatatatatatatatatatatatatatatatatatagttgttattgttgttgttgttgttgagacagagtctcgctctgccacccaggctggagtgcaatggtgcgatttcggctcactgcaacctctgcctcctgggttcaagcaattctcttacctcagccttctgagtagctgggattacaggcgtgtgccaccacacccggctaatttttgtacttttagtagatatggggtttcaccgtgttggccaggctggtcttttgaactcctgacctcaagtcatccgcctgcttcagcctcccaaagtgctgggattacaggtgtgagtcaccgtgactggcccctctctctctatttttaaacagctctaatttaacctattttatttttaaaataaagggaaattattttattttcatgcttttgtaagacttttcacataaatacaatgatgaattggagaaaaatcttttaacacactatatggcttaacgtatagttgaaaaatatgatatcttaacaccacatttttgtgggtaaataatgctccacataaatgatctgttcaacagatacaaacacacacacacaaacacacacacacacacactctctctcaaattgcaaatcagtaggcatgttatccacaagaaggcaaaataaatttgcaagcttctggtaaatatagtttttaccatatgccaggagctgagttatttcttataactgaagtttattcctttgaaagccacaagcttaattttgggggaagaaatatttctaaaatatatggcatggagagacgtcttcttaagtaaaagccactgaacataatttaggtttctgattaatcaggctcatcaaagtgaatatcaactatggtgctaacttgtacatgttacactgctttcagagccagttcatgtatttcagactctctggccctatgataatgctgtggtttctgagttcctttctcttctctctatctctctctctgtctctctctctccttcattagtgccatccaccactgtcaactataacttccttttgtggtcagcactgcctcattctaacaataccgccttcacacacacttccagtgtactacttctaaactcttatgacctaagaaatcagaacatccttttgtttgaattctgtgtaaaataggagtaaacagctctaaggacctagggggagggaggtcctctgactaaatcaatgtatattcttgcaagaatttcattatatataattgggcttcatagaaaatattttagtttcttcctgatttttatctatactttggattgagttgccaaataataattctttagataagaaatatattcctgaaattgaaaatattctatgtgttaagtagattacatgccagtgcagtcatatatgctcttcttattcacagtacatgagtaaggctataaatcatctcacacaaaccttggagattaggaaaatacaattgacttcaaatatcaaatctttgtaagacggtatttgattagctgtatgtggacaaagtaaaaagttgtttatgagttctaaagagtttgggaagatccgaaagtctaatccaggtgaactaggtacaatctcataaaggtaggacgaacactgggattcagcaagtgaactgaaccctaattttattatcttgtagctgagaatagcaattctcaacctctttttgcctcaggattttccacactatcatgagtaaccatagtttgctagagattctactggggaaaaaagtatctttcttatgtcagaatactttttgtagcaattcatccaactcaaagcaatttaaataatgaagataatttataatcctatatagctgaaaattccaaagtagttttaggtaaggcttgatcctgcagttctatcaagtcccagaagacagtatttcttttgatgtttcttctgtcttccttgattaacttgtcatcataagacttatttccctcatagccccatgatggctgtcagcagcaccccagcatacatgtttcctttttcatatgcagcagaaaaaagtaagcatttttgccttagcatttccagcaaaactcctcagattcactaactgcactggcttcactcacatcacccatcgaaccaatctacatgggttgggggaaggaacgagcttaatggtttcacatgtagttttcctttctaaatgtatcaaactcaaatgcctatataagccagaacaaagatataattaaagaaaatgggcctgatgtgtacactaatatattagagagtctgtgtcccatagaaaagactcagatcctactcagacccttgcaactgatgccacagaaagaagaatcagtgttggtgggtattgtggcttttcaagggaagttggaaatccagatttttatgtgaagttttagaattctttatttaatttcaaactccttatatactataccacaggcctacaaaaagcatctgcagattgaatccagactatcaggatgcaacgtatgtcctaaagaacagaatgcaatgacctgctgttgcaaggattctggtccaatgaatgattgtctttctcattgtccattaatcaattggcattttagttttctgttttagtctctgtgagcttgcttaatgggaatccttccctgagggacaaatcctttcttagtgcaccaaccaaatcaaatttctaaacctaccaggatgagaatcaaacccaggaagtaatgaaattactaaagcctttaccatctttcatggatcatgaaagccagcccaatatccctccctgattcactgtgagtcacttgcacctttctatccaggttgtaacacctttccttcaaacaaataaactgtactatgaaagaccccccaacatgtctcctcttagcaatgtgttatttttgctacagtatgatttgattcataaaatgtagatttactctgaacttctgaaaaaggcaccaattatataaaacaaggtatacttctagatttaatttctttttcctaagtagacatggaaatgtgtaatttgggaatattttggttgcaagtatcagaagtcaaatgcaaactaacttaagcaaaataaagtggatgtaatggggaatgtacctctgaagtcagaggggcatttcattagctgtagacacagctagatctagaagctccaattctttctctacctgccacttctacttgttttcattctcacagagccccacccccactccccatagaggcacaggagtgagagaatgtgaccgtcagccaccccagaggtgttttgcagcaatttcaacagaaatactgtggctagcctgactttaatcatatgctcatccctggaccaatcattggggacaaggaaaaggggtactttggctagatctgggccataagaccacccttgtctcataagaccaccctaagattaaaataatataaactgtgtttccccataggaaagaagggttctactcccaagagaaagaggtaaagtttgtggacagacaaaagcaacacaaatccactataacaatttacaaccggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaataaataaataaataaataaagaaaagcaggaaaaaaaaataacgtatatccacataagaaaaaaaaaaaacaatttacaacctttggaattaatcctttgctttatctactacagatagaaacactattctgctgatgaagaggacacattcaaataagttctatattaaatctaattaaaacacaataaaagagaatcttctacagtaatgtgaaattccttggaaagtacagtgctacttcattatataaaacacagagatggaagagacccagcaacgatgcaggccatccatcaagtggtgtattttaagcctttctccttcccaggccagtctagccggagtgtcaaattatgccacttatgccacatttcttaacttaataatcctctcagtcaggacattttgggctgattgaacatcattctaagctcatgtgagtccacagcaaagtgagatctcaaaaaaccgttaaaggactgggagggaaagtataagtggtacatgtggattcttacataaatctgaatacaattttgagcatttaaagttgtgtactgctacgctatgatgccaggccttcaggaagtgctctctgtaagccaggatgatgtctttgaattgacaaggagcagaagaggctagtatgaggcactgctacgacatctggtattctctggtgccattgaccagtttgggattttggggtagcagtttagaatcactaatgtggtcaactgagagctattgatggtgctcctcttcccctcaaaagcttagcactcaggtgcctcagtgttgaaaactctaattttagaatttgtgtgtttggtttatgcatctttctttttccacagtcctcttttaaagtgatcactctccccattccagaggtaacatattaagtcattctgtatataaatggtgtctattctattctgttttcatcttgcagaaggaacacttacatattcagagacctcttggaacttggagctgggggtggcacaaaaagagtgtcaagagcaaaatttaaaactggccagcttgccagagtctggccctattgcccatcagtttcatagcccctcaagtggaggaggtctctttagctccactacagactcttctaggaagctcctgatgtgttagggctactagacctacaggcttttccctataggagtagaggctgcaactctggaaaaggcgtaaaggttaaacagccacactggccagggagttagggggagtgtggtccaacaaaaggatagaccctagagcaagactcggccggttttgtttccggggaagatcagtagagcatatcccttaggacagaagttggatacagtatgcagagcaggaatgcttaggttgagttataaggaatgagaatttggtcaattacattctcttaatgtctaattatccctccttggtcttgcttaacaaattcctcctcttctttttaacatacgatttaaacgtttgtaaactgttatcacacccttgcttaatgaccacttagcaaagccgcattttaaatccctttcatcttttactgtaaatcaacccctttcttcaatggatctttttgttctctcattgctggtaagccttttctcttttctctttccttccttccttccttccttccttccttccttccttccttccttccttccttccttccttcctcccttccttccttttctttctttccttttcttttctttctttctctttctttctttcttctctctttctctcttttctcttcctccctccctccctctctccctccttccttcctttctcctttccttcctttttcattttccttttcttattcttttttcttaaatcttattctggaattaaaacattccagccttgttaattggtcctgggcgattacctgctttggtcgaattctccttccacttttcagcaccttttctttatctacagaactgctataggagtggattccatattcttcaataattgctacaatacagccctgtttctcaaattttattgtacatcaaaatcgcctgggagtgttcctttaaaatataatttattttgttccattttcctgatgaagtagcaattcattaattacttccccagttttaaaagaagtacccataggtaattgtgatgcaagtgatccagaggctacaccctgagaaacactgctatagaccttagaggaaccagaaaccattctccattaatcacctatgctagtgctttgccaaaggtggtggtggtgcacaaaataatttcaggtggtccacaaatgctattgatattaaattatacaggattacataatgagaaagctttgccttttacattctttttccattctcactttagtacaagtttgttttgaacatttacctgacactttctaattaaacttttcacaaaggaaaaacagatctcaaagccacaggcagcaaaatttagctagattttaagaatattgttttgttttcattgcatttacttttactcttgccttccatttatggcaaatgatactggtttgcatttactgtaatgaggtaaactctccttttcaaataaataaaaacaatttaagtaatttaaagaaataatgtattaaataaataatagtaaaattagcatgtgtataaagcaaaaattgtgaaggaagctttttggtggtaaagagagataataaacttgggaaggtgattcacagaaatctcaagtgtgagaaccaaagctgtgcccaggtaaagccattagtttgacctttttttttttattttgctgaatcatctgttgtcattaccaatattttcgagtaggagatcaattgttgtattgttgtctcttggtaatatttataattcaccaaaaatcacttgcgctgtttgacttacactatcaatttttaataaatccaatcttttcatggctgtgagttcacaattttgatatttgagtttctactattgaatgaggactcatttctttccttcttcttttggctatctgtgagtcactcctatttgcatagaacacagtgctagacactgtagtatggagaaagaaatgtaagaaccatcctctaggactttaaaatctagttggagagtcaaaaggaaaacacataacaaaagctagtgaaggggattagaatacgccatcccaaaatatgccacttttgcatgaggcttatttagagctgaaagcaattgaaaatcgactgaggaataaaaatgaaatccaaagccccccaactgactgaggagaccccagagaaaccttggaagctattcccagtcatgatgagatgggaggttggacacaccttgttatattccaatcctcactaatggccattaggctttcttccctaagggctaaacaaagccagaccctttgaaaggctctactgcttatgtcaatcaacggtctatgttgcctcacccttttctggttttgccacaacaatcaaccagcattcctccctgataaaagaccactgtccacggagtggttctggcctatctgtggagaatgtgcagtgacagttttcatcattgcttcaccttttgatgtcagagggccaaatactccaccctcagatcatgctaatgctgccactttttgtacatgggactcataaaggggcataaggctcaattgtgcatgtgcacgtttttcctttcataaatattcatgactcctcctatagcttattaaatatggatatttagccaccctgctcagtgtaaattcttgctccctttgcccctctctcaaagtgtctgtttctggccagaggctatgcttccccgcctgtcaaaatagccaccttgcaggctgcaaccctttatgagaaataaagctctcatttctaaatctgtgaacctcatcattcttcagttgaaacaacaaatgcaggaagaattctttgctctccctttatctgcataaaagcagggcataaatttccctttgtgatggtgttttctccctattccaggaagggaaagaagagtaacttttatcattggagatggagagtccataccaagatgagtttgcataaacagaccttactaaaataatccttatcttttattacattcccattttttttattatactttaagttctagggtacatgtgcacaatgtgcaggtttgttacatatgtatacatgtgccatgttggtgtgctgcacccgttaactcgtcatttacattaggtatatctcctaatgctatccctccccactccccccactccacgacaggcccccgtgtgtgatgttccccaccctgtgtccaagtgttctcattgttcaattcccacctatgagtaagaacatgcagggtttggttttctgtccttgcgatagtttgctcagaatcatggtttccagcttcatccatgtccctacaaaggacatgaactcatcgttttttacggctgcatggtattccatggtgtatatgtgccacattttcttaatccagtctatcgttgatggacatttgggttggttccaagtctttgctattgggaatagtgccacaataaacatacgtgtgcatgtgtctttatagcagcatgatttataatcttttggtatatacccagtaatgggatggctgggtcaaatggtatttctagttctagatccttgatgaatcgccacactgacttccataatggttgaactagtttacagtcccaccaacagtgtgaaagtgttcctatttctccacattctctccagcacctgttgtttcctgactttttaatgattgccattctaactggtgtgagatggtatctcattgtggttttgatttgcatttctctgatgaccagtgatggtgaccattttttcatgtctattggctgcataaatgtcttcttttgagaagtgtgtgctcatatcctttgctcactttttgatggggttgttttattttttcttgtaaatttgtttaaattatttgtagattgtggatattagccctttgtcagatgggtagattgtaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggtttccttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcggatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattctcttggcaatgcaggctcttttttggttccatatgaattttaaagtagttttttccaattctgtgaagaaaagaaagttattggtagcttgatggggatggcattgaatctataaattaccttgggcagtatggccattttcatgatattgattcttcctatccatgagcatggaatgttcttccatttgtttgtgtcctcttttatttcgttgagcagtggtttgtagttctccttgaagaggtccttcacatcccttgtaaattggattcctaggtattttattctctttgaagcaattgtgaatgggagttcactcatgatttggctctctgtttgtctgttattggtgcataggaatgcttgtgatttttgcacgttgattttgtatcctgagactttgctgaagttgcttatcagcttaaggagatttggggctgagatgatggggttttctaaatatacaatcacgtcatctgcaaacagggacaatttgacttcctcttttcctaattgaataccctttatttccttctcctgcctgattgccccggccagaagttccaacactatgttgaataggagtggtgagagagggcatccctgtcttgtgccagttttcaaaaggaatgcttccagtttttgcacattcagtatgatattggctgtgggtttgtcataaatagctcttattatttttagatacatcccatcaatacctagtttattgagagtttttagcatgaagggctgttgaattttgtcaaaggccttttctgcatctgttaagttaatcatgtgttttttgtctttagttctgttcatatgctggattacatttattgatttgcgtatgttgaaccagccttgcatcccacggatgaagccaacttgatcatggtggataagctttttgatgtgctgctggattcagtttgccagtattttatggaggatttttgcatcgatgttcatcagggatattggtctaaaattctctttttttgttgtgtctctgccagggtttggtatcaaaatgatactggcatcataaaatgagttagggaggattccctctttttctattgattggaatagtttcagaaggaatggtaccagctcctctttgtacctctggtagaattcagctgtgaatctgtctggtcctggactttttttggttggtaggctattaattattgcctcaatctcagagcctgttattggtctattcagggattcaactttttcctggtttagtcttgggagggtgtatgtgtccaggaatttatccatttcttctagattttttaatttatttgcgcagaggagtttatagtattctctgatggtagtttgtatttctgtgggatcattggtaatattccctttatcattttttattgcatctatttgattcttctctcttttcttattagtcttgctagtggtctatcaattttgctgatcttttcaaaaaaccagctcctggattcattcattttttgaagggttttttgtgtctctatctccttcagttctgctctgatcttagttatttcttgccttctgctagcttttaaatgtgtttgctcttgcttctctagttcttttaattgtgatgttagggtgtcaattttagatctttcctgctttctcttgtgggcatttagtgctataaatttccctctacacactactttaaatgtgtcccagagattctggcatgttgtgtctttgttctcattggtttcaaagaacatctttatttctgccttcatttcgttatgtacccagtagtcattcaggagcaggttgttccgtttacacgtagttgagcagttttgaatgagtttcttaatcctgagttctagtttgattgcactgtggtctgagagactgtttgttataatttccattctttcacatttgctgaggagagctttacttccaactgtgtggtcaattttggaatcagtgcgatgtggtgctgagaagaatgtatattctgttgatttggggtggagagttctgtagatgtctattaggtctgcttggtgcagagctgagttcaagtcctggctatccttgttaactttctgtcttgttgatctgtctaatgttgacagtggggtgttaaagtctcccattattattatgtgggagtctaaatctctttgcaggtctccaagggcttgctttatgaatctgggtgctcctgtattgggtgcatatatatttaagatagttagctcttcttgctgaattgatccctttaccagtatgtcatggccttctttgtctcttttgatttttgttggtttaaagtctgttttatcagacactaggattgcaacccctgctttttgttgttttccatttgcttggtagatcttcttccatccctttattttgagcctatgtgtgtctctgcatgtgagattgttctcctgaatacagcacactgatgggtcttgactctttatccaatttgccagtctgtatcttttaattggagcatttaacccatttacatttaaggttaatattgttatgtgtgaatttgatcctgtcattatgatgttagctggttattttgctcgttagttgatgcaatttcttcctagcatcgatggtctttacaatttggcatgtttttgcagtagctggtactggttgttcctttccacgtttagtgcttccttcaggagctcttgtaaggcaggcctggtggtgacacaatctctcagcatttgtttgcctgtaaagtattttatttctccttcacttatgaagcttagtttggctggatatgaaattctgggttgaaaattcttttctttaagaatgttgaatattggcccccactctcttctggcttgtagagtttctgctgagagatgcactgttagtctgatgggcttccctttgtgggtaacccgacctttctctctggctgcccttaacattttttctttcatttcaactttggtgaatctgacaattatgtgtcttggagttgatcttctcgaggagtatctctgtggcattctctgtatttcctgaatttgaatgttggcctgccttgctaatttggggaagttctcctggataatatcctgaagagtgttttccaacttggctccattctccccattactttcaggtacaccaatctgacatggatttggtcttttcacatagtcccatatttcttggaggatttgttcatttctttttactcttttttctctaaacttctcacttcatttcattcatttgatcttcaatcactgataccctttcttccacttgatcaaattggctactgaagcttgtgcatgcttcacgtagttctcgtgccatggtttttagctccatcaggtcatttgaggtcttctctacactgtttattctagttagccattgtccaatcttttttcaagatttttagcttctttgcgatgggttcgaacatcctcctttagctcggagaagtttgttattaccgatcgtctgaagacttcttctctcaactcgtcaaagtctttctctgtctagctttgttctgttgctggcgaggagctgcattcctttggagaagaggtgctctgattgttagaattttcaccttttctgctctggtttctccccatctctgtggttttatctacctttggtctttgattatggtgacttacagatgtggttttggtgtggatgtcctttccgtttgttagttttccttctaacagtcaggaccctcagctgcaggtctgttggagtttgttggaggtccactccagaccctgtttgcctgggtatcaccagcagaggctgcagaagagcaaatattgcagaacggcaaatgttgctgcctgatccttcctctggaagctttgtctcagaggggcacctggctgtatgaggtgtcagtcggcccctattgggaggtgtctcccagttaggctactcggtggtcagggccccacttgaggaggcagtctgtccattctcagatctcaaactccatgctgggagacccactactctcttcaaagctgtcagacagggacgtttaagtctgcagaagtttctgctgccttttgttcagctatgctctgcccccagaggtggagtctatagaggcaggcaggcctccttgagctgcggtgggctccacccagttcaagcttcctggccactttgtttacctactcaagcctcagcaaatggtgcatgcccctcccccagcctcactgccgccttgcagtttgatctcagactgctgtgctagcagtgagtgaggctccgtgggtgtgggaccctcggagccaggcacaggatataatccactggtgtgtggtttgctaagaccattggaaaagtgcagtattagggtgggagtgtcccgattttccaggtaccgtctgtcatggtttcccttggctaggaaagggaattcccccaccccttgtcttcctgggtgaggtgatgccccaccctgctccatgggctgcacccactgtctgacaagccccagtgaggtgaacctggtacctcagttggaaatgcagaaatcacctgtcttctgtgttgctcatgctgggagctgtagactggagctgttcctatttggccatcttggaacctctcccatttgttttgtagtcactttctcatgatttaccttcccttgaggcctgtattaggctgttcttgcattgtgctaaagaaatacctgagactgggtaatttataaagaaaagagatttaattggctcaccattctgcaggctgtacaagcatgcactggcatctgctcagcttctggggagttctcagggagcttttacttatggtggaatgtgaagggagagtaggcacattacatggtgagaacaagagcaagagaaagtattggggaggtgccacacactttaaaaaaaccggatctcccaagaactcactcactactatgaggacagcaccaagtcatgagggatccacccccatgacccaaacacctctcactagacctcacctccaacattgggtgttacatttcagtatgagattttggttgggacaaatatccaaactatatcaaagcccaacccccatttcctttgttaaaattatatataagcccctgagtctacttctttgagtttcacgtcttttctgtgaactcccttgtacataaatattaatgaaaatagtactcctctccttctgttaatttgtcttttgttagtttaattcacagccccccaggctcaagaaaatttttttcttccatctattagtatttattgagcacttcttagttagcacttactatacagagctaaaagctcttcattcattatctcattttatcctcacaatgaccttctgaagtaggtattaaatacatatttattgaactcttaccaggtgcttcatgtatgttctaaaattctcacaatgaccctgtaaagtcatgataatgatcagtcccattttaatgaggggataattttggctccaaagccaaaactctttctgccttgctgtaatcccagttttacaaatgaggaaaccgaggtttaaaaaggaaaaagtaacttgctccagaccacatgactggtaagtgacagaactgggatttagtttgactctagggcacatgtccttaacccttaaggtatactgtctcacaaaacaatgcgctaacaatgtaaaagaacaatagagcaatgtcatatggcagagtgtggcaatgataagtttagcagaagaatttccagacattgtctttttttccaggagaaagcttgtaaaatgtgtattgttttcaatttccttgtacagtgtatttgcttttatactttgttttgaggtttgtttttttgtcaaaattaaagggcaactagttcaacacccagactcctcaatgctttgggccaattgtcttgctgctctgatgatacagatatgctccattttcttgtgttctatttgctgttttatcgatacagttatggataaaagaaagctctttgcccagatgcattctttggccttaaattggcttgacgggtggacactacctttggacaattaaccgctttagcagcaaaagtcttttcagatcagcagtgctcatagtctattgatgtttaaatctcaaatgcctcgaaattaatcttttctccagcttttgaatacagcagcttttgaatatagcagctttttgtttttatttttgcctgagaggttctacattctgttgatatcatggctttctccagttaaatcaattttgtcactccctttcaaacaaacaaacaaacaaacaagtaaataaacaaacctgttccaaataaagcccaggaagaagttaggccatgaaagatgaagagcactttgacctgcagaagtgatgattgtggtgatggtggtgtatagatgaacatgtggcagagggaaatggaaataaaaagaaaaaagcaaaatggcgtaggaaacaaggacagaaaaaaaaatccaattatagtcggtttgttagagttcttctctttatatatgctatctcatctagagattcccttgaagacagaggctctgtgttactccattcaggagtgctgtaggaaggaaggtattccatgagtggtattgtaattgaatatcaaaccaagatggtgcttgcttttcaaccctgaaaagaaggttttaggttcctgctctacttggaaataaagtacatatttcccatttatgtaataggttatgtaaatcttcttaatgaaactgaaagtaccagttgaatactgtgtgaaagagttcctttaaaaatgctcttgtggagtcacaaaggacaggataattaaaactccttgcagagtttagttctttgacctctcattagtttcagcattataaattgccatttgttagcagcctaatttgattattagcccctctgagcttacagcatgcattctgaagagtgttctctacgtgactcagaacgcacgctgctgctgcatactggagatggaaaatggaggagcaaattgccttgctcctgtgtgttcatgagttagtcatactaaagtggttaaacaaagggaaagcagtcctttccaacatccacagttatgagtttgataaaagaaactcagtgggcagtatgactatttcattctggaagcagctttattaggtgtcatggagggaggaggagaaagaggaaattttagtccctatagttttatcatttaaaaaaattggcatgtcatatcaccttatatcaccctgcatggtgaaatagaaacttacttcctcaaggtatttcaacaaatgattgcaaagatttagagcaggggactactagcacactcattctttgcctctctgggtaggtactgtggtctcagcattttaattaatttcttgatattgctactagggggcttagcaagtgtaaacaggcttcttgccaaagccaatgtccataaaacaacctacttctattatttttaagggaacaagctgaatcagagggttgtgagaaagcagaaaaatacaataagaagaatatggaaatgaaacacccccaccctctgtgcttgccaaatacaaataactgaaaaaattgctcccactgcctccattacactccagaagatcaattaaggcaagcatgaaagtcttcaacttttccaagtttgagattgtgaaagaggcttatatgaagtgagagttacagttcgaaaaatgtagaagaacatacaatcataatagtagcagtaatagtaagcagtatatactacactctctctctttgtgaacttctgcttaatcagccactgaattaattaacagtaagacccagcaaggaatggccatggtatactaactgcttgtggctaatagagtggttagaagtagtgtggctggaaatatctagttcgcccagacatttctgcttcaatcatttaagttgtacgcttaccaaacattagttgagcttgttccaaatctatttatgccagttgtgcataataatataattatgtgatttaattaactattatataaactgatgaaatatgaatgcaaagtgagttgttgcttcaatgaaatctcggctgaatgtctttgtaagccttagttaaaacaggatgctgaaaaaaatccgtcaaatttggcgtgggtgagaaaaaagcagaagataggaaaattacaatagtttaggaagattctacattcagattgcttcacacgttttgttttttagtttattttatggaaaattgcaaacatatctaaaattagaaagttgactgtaattaacatgatatactcatcacccagcttcaacaattatctctacaggtacaatctggttttatctatacctcacccactctcctgccaaattattttaaagcaaatctcagctatcatatcacttcctcttgtggatcttttaaagttctcattccactttaaaggaacccaaatgggaaaatattatagatgtggcttgtataatagcaagatagcacaaaactccaagtgtcaacccatacctaaggaagaggctagagggtaggaaaaaaatcatggaaaagtgattttccatgacatatctgtattggaccctagaagggaggaggtatccattaatcaacctgtttttcaaaaagtatttgttaaaatatttaaaatgtacgacatattttaatgattatttacttcagttgctttatttggctaaacagtgaactattgtactgagtcctacttactgattacaaagtttctggcataaaactaggtggtaacgataaagatgtaatatagctgacatactgaggatgattgcatgtcatggttaagataaaccattaactgggtaatggcatattttcaaagcttatttcatttgaataaaaagaaatcatggcttctcagttaaccgcaacctctgcctcccggattcaagcgattctcctgcctcagcctcccgagtagctgggattacggtcacgtgctaccacaccaggctaattttgtatttttaatagagacggggtttctccacgttggtcagtctggtctccaactcccgacctcaggtgatctacccacctcggcctcccaaagtgctgggattacaggcgtgagccactacgcccagcctaaggtttgtttcttttgagaaatcatggctttgatagtagcaaagttatcatgttaattcagttctttgtccaaattcaactccttcttttagcatagccactccagttcacaatggtggcatactttaatgattctgtgccccacgtctcaacccccagacatatctgactggactagggatactgatgtcagccaattgctcttcctcaagaatttgaagtaagatacataaatctagttagaaaatgggagggtgattgacctgaatggttgcttcagccaacttaggccatatgaaagcagaggaggtaagatgaagagagaggacacagagacagagatgcagagaggagagaggctttttcgctttttttttttttttttttttgagatgaagtctagcactgtcgcccaggctggagtgcagtggcacgatcttggctcactgcaacctccgcttcctgggttcaaacgactctcctgtctcagcctcccaagtagctgggattacaggcacccaccaccacgcctggctaacttttgtattcttagtagagacggggtttcatcatgttggctaggctggtctcaaactcttgacctcatgatccaccacctcggcctcccaaagtgctggtattacaggcgtgagccaccacgcccagccccaaactcacttttataacaaagccacttcgtaataactagtccactcccttgattacggcattaatccattgatgaggacaaagccctcatgacctgattacctcttattaggccccacctcccaatactgttgcattaggattaagtttccaacacatgaactttggggggcacactcaaactacagccgggtacaagtagagaatcaaaaggcagagacaataaatcacctcatagtttaaaccaaatgtagcactagctaggttttctatgtatgtgtgtatatgtgtacatacactcatgtgtatgggtgtgtatgtatgactatttaatatcaaccaatacctatgctatttagaaagcattcagggccgtgccagtttaaggtacttcattcacatgttatctcatacaggaagaaaggattatctactggcaaacccaggcctagggaatagggcaggatttcatattttgttcacatttttactgctatgctcctccattatttcaaagttgtttcagcctgaaaaacaggatttggggtttttattttgtttcattctccatgaacttattccaggtcagtgccagaagataatgatttcccatacattttgtttatttatttatttattttggagatggagttttgctcttgttgcccaggctggagtgcaacggcgccatcttggctcactgcaccatccacctcctgggttcaaatgattctcctgcctcagacttccaagtagctgggattacaggtatgcgccaccatgcctggctaattttgtgttttttgtagagatggggtttcaccatgttggtcaggatggtctcgaactcctgacctcaggtgatccacctgcctcagccttaatgaataaatgaattaatgaataaatgaatttatttattccttaatgaataagtaattggtagtattacagataaaattcctttaattaacactctgttaattcatcacttgggctgttaaatgggtatattgctattgagcaaaatttgcttcaagcaggacagaagggagatgatcaaagccctatgctcaaattgtaagaacataccttggcccacttgggtttaatttgggttcagatcataagcaaatttgaatcacccctgatttgaccttagcctcttttctatttatcagtattacctacaatatccactctgctctcctcatgaaataccctgagtgaaatgtcagggaatattttgcatttaggtgggagctaaataatgtgtacacatggacatagagtgtggaataagagacatcagagactcagaaaagtgggatagccgcacgggggtgagggatgagaaattatttaatgggtacgatgtacactattcaggtgatggttacactagaagcccagatgtcaccactatgcaatgtatccatgtaacaaaactgcacatgtacttccttaatatataaaaataatattttgtattatcttacaaataacagtctgtaagaatttcaaaatctccagtttgaggaaaacttggaagggtattcagggagtatggttagaacttttgttttgcaaatagctctgtccaagtctagcactagtcaggcccactttttcttttatttttttcatttttcttttctttttgatactgagtttcactcttgtcacccaggctggagtgcaatggtgccatctcggctcactgcaacctccgcttctcaggttcaagcggttctcctgtctcagccccccgagtagctggtattacaggcgcctgctgccacacccagctaattattgtacttttagtagagacggggtttcaccatgttggccaggctggtctcaaactcctgacctcaggtgatccacccacctcggcctcccaaagtgctgggattataagcatgagccaccactcccagccccacctttgcttttctatgcactctcctagaggaaatcacttgccttacctggatctcagtttatgcatttgcaaattgagcaacatgatgtagattcactctgtaagtctctcctcagtggataattttacatctcatacaatatactttccaaaagcaacagctcactgaaatagaattatcatgttcttttttccttttagaaagtcacttaattggatggcaatgcctttcttagctggtgaatctaatatttgatgggtaccagcctagtttgtactgacaccttgtgtggcttccccaagacattatgcaatctaacatgacacttccatccagctcatctggcccagaggttaaacatgttcatttgcttattttcagggccctgcatacacatatctaccaacacttctagcacttggtaaaaaactaattgcagagagacttggcactttacctttctgtttgctcttggcaggattgttgttttccctttgcaattttatgagcattgtatggtctttaatgaatgaccaaaatgtctttgtttttagagtatgacagagaactatcattcccctttaaaaaaaaatctttggaaaatagtctgctcaatatctaaggctgtcactcattcaaaaacattaaataggtcgggtgcagtggctcacacccgtaatcccagcacttagggaggccaaggctggtggatcatgaggtcaagagatcgagactatcctggccaacatggcgaaaccccgtctctactaaaaatacaaaaaaaaaagaaaattagctgggcgtggtgccatgtgcctttattcctagctactcaggaggctgaggcaggagaattgcttgaaaccaggaggcggaggttgcagtgagccgagattgtgccactgtactccagcctggccacagagcgggactctgtctcaaacaagaacaacaacacaaaaaattaaataaatttaaaacagaaaaaaatctctgccacaaaatgaaggcaacttctagagaattccatatgagcaatttctagtttccattaggcattacaaagccaactaatcctcaactctacctcactcacatagtacagggcttccccacagatctattcactgtagctttcctcagtctaatttccatcctcataaatctatagtgttaatgatacaactgaaggagaggtttggaacagtcagtcagatgtatgcattcttttctttgaggttttacatacaaatgttttactttctgagtcctgagaaaaatcaaaacaataagttttatcataaatagtatcttcatccccagggataacacttttggcttctatgacattcaaattgatgtttctattcctaaggcatttccttgtttttacataagttgtcttttctcacaccattaaaaaaaaataactaaacctttgatgtaacttccatgctctcttatatcttctctaatagtacatatttgattattttattacacaacatcagaagactatatggctaaactcagtgctactcatattctggaaaaagtgttcatctttccaactggctgctgaagcaactctaccaagggaaaagtagttcagacttctcattcaggtattgctgtcttgccttgaacagttttcttacacatttctttgctgtcatggtttttttcttacaatagaaaacagctaataaataatgtttcactgtctgctgctgttctgaccccagtctcctttcacttttcaagatgggagtttcgaatgaggagtacactggtttatttgccatatatatttgtatttgttagtaagagattgcagcctactaattctctagggaatggtgacatttgggacctgtatggatgtgctataggttacatttataacattttgactcacatgattgcttcagttattaaatacttcaatgtgttttgagagggctagagagttacccataacttcaaaattatttcattgtttccagcttctattacactgtagacaatagaattgacagtgtagaaaacagcagaataaagaaataagtgactttttctgtttctgaaattgtcctcataaaattaataaaactaaattgctaggcttttaacaaaggcataagccttgaattgaagcatagctaagtattagccatcttgccttacagcccacttccttatagctgcttactgcttagaagtctcataatccctgtcacaagggcctgacttctatagataacatctttaacattaagaaacctcaagttttccattccagatcctgtgttccaatgggtccaaggatgttagccagtctgaagacctcttccgagaaacagacccagcacaggaatgtggtttctttatctccgtgtcccataacttcactcctcacttcttgaccaatcagcaaccccagctcctgagctgcctacccatcaaaattccctgaaaaactccagtccaaactccatggggaggtgaatttgaggtttgaggtttcctcccacttccttgtttgactgtcatttgattattaaatatttcctttgctgcaactcccactgtcttggtgtattgatctgttatctcagaatgggcacggacctgatggtcctataatacttctgtcatctaggagtctaaggaaaaacttaacgtattttggtgaagaattttataaagcataaactatcaataactatcaggaatatacagagcatattaaaaacactatatattagaacaaagatagaaatatatttcaggaagaaagattgttcttcacaaagaggtaataacacagcttgttagaaagaaccaggcctttacccaaatgatggtttggtggaattgaatagccacagaccagttgttggactgacatggccagttatttccatcattttagttaaactgacacctggtttttctaccaagttaggatgagcttctctgtatgttctttctaaaactagaagagtcaccaaattgtgccctgctcccaacgtaaaaattttttgctatattgaagatatagtgttaattaatcactgtggtgcaggtaaggacttcaacctggctgaatagaatctgtggaatcaggtacttccagggcataaaattgcatgaaacaaaatatttggaatttttatcttcttccccaagtgaaatgatctcagcattaaagtacaaacttggacaagaaccaggcttcagccgtagcacattggttttaactcagacatgaagttctttcctgagtactggattacaatggcaagcaatccccttctactccctggcttgtggggaaaaattagctcactgtagtgccagagctgattcaatggcttctacaaaccctgggcccctaggcaagaacagtttagacagcatctcaacaggaagtttaagaactgaatggccagtccagccatatgggtggttcagggaggggacatctgagattgtttgttttcccttttccttaagtactcatttactaacaatttctggtctgactctatcattctaatctacaggatcagaagtgtgtgcaagctataagtatatcagatatctcataatgggtggggaaggtattaatatatgtgtgtgtaccccaagttcttcccactaagcataaaattgagattgtggaaatggatggttcgttgatagagctttttcttcccatgtggctgcagcattctttctaaaccattctgacctcaactttcagtcaaactgatcagctattgttctagttagtgacaggaacagatttttccatgtctatgctgctgtggaataggatctcagttaattagttcggcccaaagttacggctgatgtggttctataatgattttgtctttatgtgtatagaaatggcctatatctagtttctctgtgttgcctattaggttgcaagtttctaggctttaagaaattcatcttttattttaatcatgaactgtacctgttatatgattatagctgtacctgctgttgatggtatttcacatcaaatataattttagcatttgtccccattgaacctaactgacattcagtcacatctgagtgcatctggttagctgacaggaacacctacaggctcgatttacattggtttggtcccttggggagaagaggcatgggagaaggaaaagagaaggggaaggagggagataaggagaagaagggaaagaaatgtcaggaagagtcttgtaagtgggtaccttgttggcaaagatgaaatagcagagaaaggatggggaggatagctcagtgtctgtcttctgttctatccccaaagtcttgcatctaaactttttaaatagaggcattgtaggcaaaaacagaaagatctgtatttacaaaggacttgagaaacacatggtctagtatgccacggtcaggtggtatagtatgtcatggtcagacacaggtggagtatgccatagccttaatgattcagtaagcaatggaacacagaagtatgtaactgtggcatggtgagaatttaatgaataatgaaggtagagagtgctaatgtgggtcttcctccaggctaaaatcatacaatgggtagcaagttcatggtatctgactcctctaaacttgctaatccctccttctgcatagaatgcattcaccactgattttctggcacttccacaagaaacccgggtagcagttgggagctgcatcatttataatcataactggtatatatcccttctagtcttgttttctggtttggcaacaacacaaagtgaaagtaatcttgagtgaagtctaagtcatcaagaagtcttcagtctttaatggtccagcattgtggtcaggtggccaaacgtgacacaaaatggaggaaaaggacatcctatgtggacacagtgtgagctcagctcaaagaagattgaaggaattctaatatgtctttgacatcactatgctgtgcagcttcagaaacatgaggagaacatggcatggacatggagggcaccatgccaagaagcaggtaggccacagtgagatgccatgctcatgtagctagatggcagcttaaattaatgagattaatgaaggtatccagaaaagaaaatataagaccactctttgtaagttcacatgagccaccccttaaggatatccacaactagctttataaggcttgatatggagaagaggtaggatacccatacttccttcattatctgttatttaacttactgttatcgttgctcctcgacacttacagaaataataatcccatatatttatgtagcctttacagtttacagagtgctttcacctgcattcactgatttaatactgaaagcaaccctgtgaactagtgagactgtagaatttcctgaatcccctcacagggtgtgtgacaggtgtgctgttctctgttcaactgccataagctgaaatcccttaagggaagggaagcacacagacaggcaggtgcaggagccagggtgagcgctttgggctcaggccccacagtagggtctaggggtgggtgcctgcaaccccagtgttacaatgctcctttagctctgccatctacagatggcttaagtgttaaccagctcagtgcccctctccctttctgcaagggcagagggccagtgtgagaactttctgcatcccgagctcttgtcgagtgtcccagaagaattgggtcacacacggatttgaaggatcaatgtcagggttttatggtggtggaggtgggtctcagaggggtggatggggagctggaagggggatggagtgggaagatgatcttcccctggagtttggccatccagtggtggaactcctctccaactgcccccagccgaactcctcttgatgttcagacatttcttgtcttctttctctgctgcactgttctgctgttcatctgcttgtctcatcttgtgtccttgtctccttgtctgattctggagcctgaggttctgggtttatatgggtccaggatagtggacatggcgggccaaaacacaactctttgggcaagaaaacaggaatgcctgtcttcatttagagctgcaggtatccaggcttgagggtggagcctttgctagtgaaccacactcttttgcccagtattttcctgtcttctgtctgtatcagtagtacagaagagaaaaaaaattgcttctctctctccccctaggttctttgtctggtatacaaattaaattgacctaaaacagattaacagcaaaaaagggcaattttaattacatatgtatatatggaagtctcacaaaaataggaaacttaaagaaaggtcagatgattgaagcttatataagattctgatctacagaaaggaatagaaacttggcatttctaggcagtggtgaagacaaattataggaggatgaggggagaaaatttacggtgaataaagtttgccttgttatgcaagtaagagtttctcaggtgataaaagttgtttcttagcagttctcttcctagtacagttacctttattaatgaaaatttcttttgtagatataaattcctttacaaaaggggagcttttcagagctctgcctatgtctgcaattcctcaaaataaccagctatacataatcaatatgtcaaataagtatattttgggatggcatattctggtctcctaaagtccagaatttttggagtggcatatcctgagctccaacagtaacagggtattataatcattatacagatgaataaagaaatctatggtctggagagttgaaaatatttttttcaaagtaacatctctagagagttgacaaactacatgtagaactcaaaccttctgaagtaggcagaataaaagccccccaaagatgtccatgtcctaatctctgaaacccatgagtaagttaccttacatgtcaaaagagactttgcaaaagagacttttccatgaaaatgatcaaggatcttgatgtggggaggttattttggattatctgagtgggctaaatctaatcacatgaattcttaaaatcagagaaccattcccagctaagggtagaaagacatgatgatggaagaagagtcagagagagaatcagttttactggctttaatgatagaggacagagtcaggaaccaatgaatgcaggtgacctttagaagatagaaaagacaaggaaatgaattctccctgtatatatttcccattctgcattaaagaattaccataagcttaacggtttaaagcaacacaaatgtattgtcttagcatcctggaagtcagaagtccaaaagggtcttataggctaaaatcaaggtggcagtagatctgcatcccttctggaggctgtcggcatggatctatttctttgccttttcaaacttttaggaaccccttgcatgccttggcttgtgactccctttctcgatctttaatgtgtatcactccaacctctccttctgttgccacatttctctctctgacctctgcttccattgtaagcatcttttgactacattgggcccacctgggtaatccaggataatctccagaaagtaacacagctttgttgacatcttgtttttagcctagtgagacaagtgtcaaacttctgacctacagaactgcaatacctttgtatgattaaagccatgaaatttgtggtaatttgttacagcagcaatagaaaaccagtacaccatttaattctcacaccagggagttaaagtatcatatcacatattgcctgcaggcttgaacagctttggagcatttgaggagtattcctttgatatctactaattagttcaggatggactttgggctttcggaatctagcctttttttgttctagtcaagaatcttagagggaatatttgttagaattttgaatttatatcacattgcacacttttataggtttttacttatatatcatctgtatccttagtcccatcttacagaagactgctgagtcattagtcatgaagcactaatgtcaggaattagaaacacagcactcatttccccagcttgctacttaatattccaaatcatactccttcctttcataaaactctttaagtacagctaaggaaaactgctgtggtcaaagattttggtggagaaaattatctaagagaactgaagatgaaaatttttaaaaagccaaggattacaagtatgtaaaccactgtgtatgtcctatgtttaccaaccacattttattttctctttggtatttaatcctacttgtttcataaatggcataaaatatgaagagaagatgaaaaagaattagagaaaattaggatttgaatgtgaacaaggctcactaggttaaatggttggtttatacgtttgggtatcagatgcatttaaataagcattgatttacaagtcagttgtgccacaagtttacaagtcccaaaatagctagtcagcaatctggaagctgtcgccctatctcgctacatcctcgggaataagtctcagcagtcacagtctaactgacaaaagctttgcggctgaaggcagaatacagtttagttcccactctctcatcggaagaccggctcagcaaacctaacaggaagaaaaaaatgtatttgtcagtaaatgaaaaagataggcctcaatggtacataaaaaaaatctggagggaaaattagatgtgtttcttgtgttgtcactccctgggccaatacaacaattacttggaagatttcaaacacacaaagcaaaatagccctaatatgcacaagacagtgaattcaatgcacgtcattgtctaacagttactacttttggaagcagcttgtcaaattcctattaggaatatatgtcttctgcagacaagctccatcctaaaggatgatcagagtaaacagaaagacaagtacatgaccaagaccaacacttactaccaacctcacaaaacccctcatgaccaaggcaactgctgatgggcttgcaggaaggtacagacagtttgtgctcccaaatctatcattgtccccattgtgtagatagggaagctgaagttagagtcttacacctacgtaactagtagatgacagagtttgaacttaagcccaggtcttcttggctcccagtccatggctctgcctgctgttctacagggacatacaaggaaaatgttaatagagctcagccaagtggtggcatggagactttcactgagggaaacaaggttaacaaaaatgatataaaaatagattgtgtgtgtgtgtgcagtagcacaatgctgtgttttccatccttctactgagtaggaattttcccgttagctttaaagggtggtttctaagttggttgctccacatatctcatatcatccttcttttcgctgccaagaagacgaatgcatttgagtaaaaagaatttctcaataacttattttcatgggcagaaaagtttaaaaagaaattctatttatcattaaaaattgggatgaatataagcatcagttgatttcaaacttttaattttgacataattgcaaacttttgagaaagttgcaaggataatatagaaaacttccaactgccctttactcagcttcacccctcatcaatatttaatattttgccatgtttgttattttcattctctgtctcatatatatatatataaaaatatatatatatatctttctttccgaactacttgagactatgccccattaccccttaactatttagtgtgttctcgcctaagaacaggaaactcttacataaccacagtgtggttatcacattcaggaaatttaatattgataaaacactttaatctacagtccatattctacttttgtcaattgactcattgatgtccacttacagcattttcaccctgctgtatagaattcagtccaatcacacatattgcatttagttttcatgtctcttttagccttctttaatttgaaacagtttcttagccttactttgttttcatgatattggcatttttttaaatacagttctttttttatagaatgtgcttcaatttaggtttctcataattagattcaagtgagactccctccctctatgctacaaaaatggtgctgagtctgttttaggaaagcacattcaggggcatacattgttggtctacccctcactgatgagagatgaggttaattttgatcaactgatcaaagcgtcatgtgttttctccatgtatagttactattttccccttgcaactgataaggaaaatgtagggagacatttcaataccatgtaaatatcctgtttcacatctatcctcctacctagcatttaacatcaatagatgattcttgtctgaaccaatctttacaatggtgattacaaaatggtgtcttctaaatctaccactccatccatacttaacagcagacattttatctatttcccattctgtctctctctttccatctctccctctctctctgtctttctctcataatgatggaggaatgaatttctattttattcaatgggttattgtccattacctgccttatttattttgatgctcaaattgtgccagatttgttgggggtcgggtggggttattttcaagctggttatttcaaaatgctctctttcattgttcttaatttctggtaagacaagttactccaggctgatcttgtacctttcctcccctggccctggcatcagccatttctctaaggagtcataattccttttaatgggagtggtatttggaaaccaagatttacacacaaaataagctcattgctaattcagtattattgctggggtgtcatattgatacctccaatcccaatcttgtcttctccctttctttattttaactccctttctttcacagtgggagacctgattccctacaacagcaacatatgtactcacttgttcaaacctgcagtacctatacacgatttcagaattttcagtataataaataaacatactaaaaagagtttcaggcaaatatttactccacatttcatgcatgggtattatcacaagaactctgaaaatggttggaagaaaagagtagagtctatgtcatctttcagctttccatctttgccttgttaaagtggcaggctcattagaaaagtaactgccagtgtgctgcttggtagcatttcaagccagtcttttcattaataaaagtcgcactggtaattttaaataacacattttaaaattcttacataaaaagaaactttgggaggtatcgtactggaaactctcacacaccatttggatgtctgtgtactggacattcataccttctactaagaagagccagagaagattaaggtttaagaaatgaaaaaagacaaaaatttatcccaaattcaaatacaccaaggaggtccagggtgctctagaaacaggcaaaactgaaaaaggaataccactccctcaaaacacaatcttataagaacactctgggctcaatcttttaaatgcaaaatgttgcaataaatgtaaagtaaaacaagccaatcaatcaacctgtggactccattactggaagagtgctccagttttgcataaaaattcagagtggttttcgaatccctaaacttgcctagagtcttgtaagattcctcaggtcaaatttctttgtactacaagttgtatagaatataaaacttaacaggcttcatggtctgctttctatgtgggtcaggattcctatgtgttctaagtgctattgaatcatatatttttatggcatagaaggaattttgaatgtatttactccaattccttttcttatagatggagaaactgaagtctacagaggggaaatgacttgtccaagagcataaaggctgtaggggaaagaaccatgttgtagaagagaattcaagcacaaggtggatggttggactgagttatctgatgttccatttctaccctgagattctgagtctgttttgtgtttgccagtacaatgatctttctactctaccctcaggggccactgaggggattggaagggagagaagttaactattttaaatattgattttcctagaaagatatttcttgaagaaagagatttgggaatcataacatgattcaattgtaatgctgtccaggactatattacagtcagaagtgcttgccatatgtgagtacatctttcaaaacatcaaagtatcttagcagctaggaaatctgatgaatgccagaacttggctgagaatgtttgtcaagttttgtcagccttgtcacagctggccttagtatgcttctttctatagccaagtaactttttggtcagacagccaactaatgtttctaatcacttctgaaattcttctgagcagcacaacctattactctgtctaacaatggtgtgtagagctatgacactaattgttcttaggagagagccatgcacacactttttcaacatgatggagtacagctatggttctactttagggtagaatgccaatatctcagactacatcatagctgttttttttttttttaacaatttgactaacactaattactcttgtgaatctttattcaaaatagtgtttccattattatgaagcaaaatgacaggaagtgtgcacaattacaagttcaagtaatagctgctagacatcttctgcacatattacctactctctgccttccaagtctacaaatgtttcagatgatgatttgagaatgatgaagacattttagcttatagaatgcagtatataaaggtgaccatcagttcattggtaagtaccctcccccatccccttaaaaaatgccatcatggcaaaagtgtcctcctggcctttaataactctcttatttcgttccacaaatatttacttaatgcctatatgtaacaggcactatgcttgatattggagaaacactggtaaacaagacctacagactccctcactgttttggtgtttagagtgcattgggatatacatacataaacaggtaaaatacaaatgggttaaggtagggggagatctaagaaactaaggggaaactaatccagttatagaactcttggatgtgacatttaaactggtatctgaagaacaacgagttatacaggtgagggaggttggggagagaatgttttccaagacaggaagaatacaagaaaatgcccagagcagagaacaacagcaagagaaaagcagcatataatgggactacaatagtacaatttagaatgtaagtttgtgagacgtaagaaatgtggctagattataaatcagttcccctgagagctataaccttgtctattttgttcaaaatagcattgctattatctaccacaattcctgtcacatagtacaaattcaaaacatatttgttgaataacaaaaataacaatgacaataaagataacagtcatttaattatgagacagaaagcattctaagtgctttggtaatgtgtaaattgattaaatcctcacagcacactatgaggctcttcttcttttcttcttgctattatttttattattattatcctctttttacatatgaggaaacagaggctcagtgaggttaactcaatagcccagacagcctaggtagtgatcggcagattcaagatttaaacccagataatcacagactctcctgattctaaggatctagattttgctgtgaagagttttaaatttcccctaatgctacgggcaatcactgaaaggctcaataagttgaatattgccaatatgagtctggcagcaatgtgaagaatggatttaagtgggagcaagactagaggtaaggcgatgaactatgaaggttttgtgataattcacgcaactggtgattgtggattgaactatgatgttgacagtacagatggagagaaatagtcagatgtgagagagggaaagagagttatattcaataagacctagtagttgattgagtgggggtgtatatgagagagacaaaggaataacggaagactttcaggtttccaaccattgcgattgggtatttggtcagtgcaactcaccaacacagacaacatgaggaaaaggagcaggtctgaggcagttggtgaggagatcacaatttaattttgagcatgatgagtttaagcttatttggggggcattcaagtggacatgcccaacagacattttcaacagacttgtctgatgcttagagaggagattcagtatggacacagagatgtgggagtcaccaatatatagctggcatttgcagctaatgtaggcaattataaccatgctggaaaattgtgtacactgataaaagcagaaaatctgagacagagcctaaataaacacaaacatctaactgacagatagaggaaaaagagcctttaaaggagattgtgatggtgcagctaaaggagtaggaggaaagccagaaggatgactataaagaaagcagagggaaaaaaatttcccaggaagaataaaatgatcaacaatgttaaatactgctgagaaaatcttccaatgtgtttagcaacatggaggcctttgatgaccttggaaagatgggtttcattatgaaggggtgtgtggcagtatgtgagaggaggaaaaagtcatatttcagtgtgttacagggtaatttacaggaaaagaaatcaaataaaacgttacagaaccaaattctagttgttcccatggaaacaagattcagggacactgaaggatttggggtgaaaagagaaatcagaagtcctaggataactgttaattagtttaacagaatggaacttaggagtagatggcataaggatgtagcaagaggtaatatgtggatggagaaaaaaggtcaagaatttgcagggaatctcaatatacatgtggttcatcgattaaattggatttagagcaaaaatcaatcagtgtataactcagtgctctgaaagaatctcactgtcctaaattaacttctgctgaactctctgggtatattcagaagccatgattagtgacactggtgtggctgcagggctaatggtggctccatctagttcttgtttgaattgtcatagacagaaaccctacactgtaagcatctgtgtcctgtatatagacctttatatcactccttgggcgatggagcagtaagtcattcaaaggcagaagctgtctcttttgttattagattctttaggcccttcaggatcttgggatttcttctcttatgaggaagcctggattttctcttttccagacttcttgtgcagtcctttatgcccaagactgagagtgcagatctcctgaaacacagatactgggaggtactacaaactactggctgtaaaaaatgggctttggagttagtcgtgaatacgagtctcagctatacctcttaaagaagtacacaaaatagactgattcataatggcaaaggtttataaattggacatcattaaaatgaatatttaatatagttatggctatggctgcatttaggtctaccattttattatttgatttccattggtattcttgttggtgcctctattctctctctttctagccttcttttgggtcacttgaatatttccaaactccattttaatttaactattggtttttaactttatctctttgtgttactttttaattgtttcccagagataacaataaacacccttaactttccagtctacttagactcaatactggactacttcatgaaaaatgtagaatcttgaaaccacagaggtccattaacctctcctccaccatcctttttgttatagttatcgtaagtattacatttatatacatgataaacctcacaagacttaaagtacccacatgtattttaaataaaatgagaaaaatatggttgtttatatttacctagatgtataccagccttgaggaacatacaatggctcgtagaggaggagctggtgaagggagctgagaaaaagcagccagaagtgtaagaggaaaaccaggacagtatagtctaagggaagccagggtaggagaaggttttgaaaagaagggggtggtaaacagtgtccaaagttacttaaaagtcaaataaaaggaataaaagtggtggcgcgtttagttacatttagggaggtaattggtaaaagctgatttggtagagtgagttgggtacaaatcaagttggagtgagttgagtaagtggtaggggagagaaactagaaacagggaagatagacaactcttgagaaattgtaaagaaggggagaagagagataggttaatagctggaaagggatatggggtcagtgaagatttcagttattttaatcagacagtctgagaatacatgaaagtcagtaggaaggatccagtcgaaaggatgaggttacacatataggctggaaaagctgtagttgatagtgtaagaatcttgtgaagatggaaagacataggatacacagcacaggagaaagattagctctgaaagatgacaggatgtgtacagtggtaggttaatatacttgctgtcaggaagatgtgggagttgacatatgatagcttctttttttctctgaaaagtaggaggtgatatcatcatctgtgagaggagaggagtatgtgttggaggctgaagaagaataaagaaggtttggaatagttgtgagtagagactgagatgtaataacctctcagaccacaataaaggtgttttactatgtatgttattaggagacacattgttgtttggctttagttttagaagcagctggactattgattactttacaaaaaaaaaaatacaactatcaagtggcttgcatatttgcagtggcactatggtgtaacagacattgtgggcctagagccagattgcttgggtttgaatctcagcactaccactcactacctatctgaccttggaaaagttacttgaactctatatgccttgatttcatcatctgtaaaataagggcaataatattattagtcctaacctcatagggttgctgtgagaattaaagttagttaatatgtgtaatgttgttagccttgcacatagtaagaactgaacagctcagtaattgttagttattattttttgctgatcaactgattcttattctactgtctagtctaggagggatgctaaattagagtcaaaagcttgctaagtggcttgaaaccaagacatggagagttagttggactattagactcgctggtgtcctcaagctatgataacctgatgtgtccatctctactatgcctgctgctcctgttacttatacttatgggtcagagcccttaggaatgctttgtagaatactgcatgtaaatgaatacttaatgattgactgatgtgatgaatttggatagagataagttgacacatatctgagggcagatggaagacagaatgtctacataatttcatctggtgatagccaaagtcacaaaattgaatcatccaaattaaatcagagaattagagaatcttgtatttggaagagccctttaaggccatctggtcgaaccttcaactcagcattggaatactccctacagcctctgtaagagagaatatcaggccagttgggaaagagactggcaaatgatgtaaaaccaaatggcatttcaaacaaaatgtggatacctaggctctgggtggtttggttttaaaccggctccacagaagacaaaacaccaggaagagtccaagttgtaaaactgtttctttctagatatagaaagcaaaggcagaagcctcacttgtcattcctgttgctaactttgcttgctagctgacaatggtgctctactttgaatcaatttgcccatctgtgaaaaggaaacaccatgtttcaatcttccatgagtgtttcccaaaaatgaaagtccttatatatctgcagacaaagtgtctttggactagaagccagccagtctgccgagttgggtaatcaaatctcagggtgagctttttgcttgctttaaggtagaaagtacctgtgacattttggttgactaggtttgggctggtcctccacagaagtgtgtgttatcaaatgtgtcggaaagacccagaatcactaccttcctccttctccctgatctctttcatctacttttagatgcctgaaatctgaaagattcgaattttagctttttggcttatggtatcagtatctgttaacttgtaatgcccctggcaaaggtaagacattgagtttctgtcagtcatttaccccttagtgggagtgaggaagactgtgaaagttggaataggaggaaagagaaagaggacactaaatgcctggagaggggggaataatggggagagtgaaagaaaattttgtatagttcacaatttatcctaggacccgccttgctccagaagcaaaacagagcaacatggttccatctaagcctctattctctactctccccttcatttcccctcccacgccccagctatttccaaattaggaggtgaatgagctctgttttcagattttatttttcactttaaaaagtcttttaaattattttgccttttcaaatacacttttgtttaatgagagaaaatgttcagtccaggcctgtagttgtgctaacactcagtctaagaaaaccattcagttctattactcttccaacacactgatttattttaagggtgcaaaagatccaaaggtattgactaggttgcactgaacactgggaaatcctaaaagtttatagcaacagaaggaaaactccttgaggaaaacacctttgcaaaagatccaaaggtattgattaggttgcactgaacactgggaaatcctaaaagtttatagcaatagaaggaaaactccttgaaggagacataattagattttttttttttttcgagatggagtttcactcttgtcgcccaggttggagtgcaatggcgtgatcttggctcaccacaacctccacctcctgggttcaagcaattctcctgcctcagcctcctgagtagctgggattataggtgcctgccaccatgcccagctaattttgtatttttagtagagacaggctttcaccatgttggccaggctggtctcaaactcctgacctcaggtaatccacccgcctgggcctcccaaaagtgctgggattacaggcgtgaaccaccacgcctggcctagatttatatttcaattttcactttgaaagttaggtttccacctagatgaatacatgatatgtgctaaagtaaaactaacaccgagacagagcagagagggcaaagactgcgcctggttcttctttttggagccaatctagcaactccctcttgtgtgcttttagctccttatagtaatgacaataaatgaaaaataaaaggaaaaataagccccagaatgatttaatccaaactaccttgacagtgagaattacttctttatggctcacttccttatatttgcaagagaatttattaatccagatgcaaagcatcttggctgtaagatagatccattaaaaaatgtattttcacatttttcaacttgttatttttacatcattttggacttagcagagaagttgtaaaaatagtacaaacaatcccccatcttttttacccagatgcccatatccccaattgtttacattttaccacctttgtagtccatgtctatataagtatgtatggatattatatatattcataatatgtatgtgtgtctatcaatatatcattttaatttttttgcatggcttaagagtaatttacagatatgttgttcctttacccctaagtacttcagtctatatttcttaaaaataagaataattccttacatatccatagtataatcatcaaaatcagagaaaaaaacactaataaaatactattatctaatctacaatccttattcaaattttgtcagttgtttcactgacttttatagccaaagaaaaagaaatttgtttcttagaatctgatctagaatcacacattgaatttacttattatgtctctttagtctccttttatctggaacagttctcaaccattctttgactttcatgaccttgacagtttttataagaacagaccatttgttatatagaatgttcattaatttgtgtttctttattgttttttcttaattaaactcagtgatgttgtttgaatgtgtgtcccctccaaatctcatgttgaaatgtgacctccaatgttggaggtgaggcctggtgggaggtgtttgggtcatgggggcggattcttcatcagttgcttagtgccttccctgtagcaatgagttcatgtgatatctggttgtttaaaagagcctggcacctcctcttctctctcttgctctctctcttgctgtgtgacatgctggctctcctttgcattccgccatgattgtaagtttcctgaggactcacaagaagcagatgctggcactatgcttcatatgtagcctgcagaaccatgaaccaaatgaacctcttttctttataaattacccagtctcaggtattcctttatatcaatacaaatggactagcacacttagtttatgtttttttttttccagaataccacagaagtgaggatgtgctattctcagtacaccagattatttcttttgcagttattagtttgaattctacacacagaagagctttctgttctcatctatgtatctattcatccacctatccatctatttaaacatttatttatattaacattgactcatgcattgtcattttatgttgtgggtgaatccattgccatcatgtattttgatggtcaaattgtcccagagttggccaatgcaagccccctcaggctggatcctgaatgctcctcacatgaccttgccattctttgagtattctcttactttctggcacaagttgtttcaagaatcattttctacttcctctgctcttgttctgaaatcagctccaaggggcaccggttctttttagtagagaatgataattaaaaactgagattggacactagttttgctctttgctactggggtattattgcttctaagccctctcagcagacaagctagaaaaaatatatgtgtaggtgtgtatgcatatatgtttgtttacttagatctatctatctatctatctatctatttatcttagattattcagacttctataacaaacaaactactctagactgaatggcttacaaataactgaaatttatttcttatagttctggagactatgaagtccaagatcaatgagttggcagacttggtgtctggtgagagggcccactttctcgtagagaacctttatctcactgtgacttcacatggcagaaggactaagggtctttttataaggaccttttatctctgtggggtctcttttataagagaactaattctattcaggacgtctctgccttcatgacctaatcacctcccaaagacccaatctcctaatactattactttggggttaggatttcaccattaacatcttggagggatatgaacaatcagttcattgctatctatctatctatctatctatctatctatctatctatctatccatccatctatctatctaaatttatctatatgcctatttgttatgctgtctattaaaaaccgtaggtatatactgataattctatttctaatccaataccacagggttcattctactctccctcctttccatatctgtatctcccttcttctacagtgagaacctggttctcattatccacaatatatttattcatttgtcaattctagaatatgcataaagtgatttcagaattgctaattatagcactgtgaagaagcaaacctacttaactagggttaatatttgtatatacttctttttaccttttacctgaatatatatacttaaaacactgtgtttaaaattacttgggtttgttttgtttctttttctattcagagtgattatgtgttatttatttgcaataaagacaggtttgtttatttctgtttgtgttcgattttgggttttctcccccactcttgtttattttatttattatgttatttatttagttttggctatgtgaaacactatcatgtttccaaagtcagaaccctgcaaaaaggatagagaagtgacttcgaaccccagccatatttctactctgttctcttctccccatccttaccaccttattcccacacatcccctgtaggtaatcagtcacattattttatgttttatccttcctgtttctttttgtacaagttagcatattcatgtatattttcttattccatgggcatagaaaaaagggtgaaaatatacttttcatttttgccagaaaaatggagactttaaagaagtataactaaatggtccccctcctgttctcaagttcacttcacacctcattttaaacttcacttccttctacagggatgcctaaattaggccttgtctttatgtcaagattgagataaatccccttaaactgtgctcccacatctcccccaacttccacattattaacattaatcacatatgatgttaaaagaagaaaacttactgctcattctctaatttaaaagacttagatgcactcaagtaaattctctgcctgatattcagtagtccctctctccctcattacctttagggcctgaacacatggtcatgttctaatctgcttattacagagagcgtaggcagccctgcggctttccatcttagcctcacttagggctaatgttttcagtacagatgtacacaagccggcaaagactggtttgaggcagaaattggccaaattacaagagctaagcagaataaaaaataaaaatccaactttaacttcattcataaagaaagagataaaatgataaaaggcaaataaaataaatcataagaaatgaaactactttagacatacgtcaattctcttgtattgaaataaatcatttattttagcagtggaggcacttatttcaatattagaaaaataatgctattgttttcagcgtaaaataaccctcaggtggaatagatgcattgatttttttaaaatggatttaaaataaatccaatgtcttcataatgaaaacttacaacattcactagaatatagtagttacataagccagtggctttccaagaaaaaggaaaattgcattcccttgctttcattggtttttgttaaatacaatttgtccattccgtttgactggccaatttgattgcagtgtactaaaactcagctaggtacaatatagatccacaggcttgacttaggaaaaccaagcccatatagcacaataattggatccacacattaattagatccagagatacatcttggcttattgtcactgggcttccaggctgaaggaatctagaaatagggtgctttgaggctctgattgattgtctatggtattttgtaccagacagcaagtatgagaaagaagaacagctgtgcaatgactataatcaaatgcaaatacctaggagtctccacaacaaaataacaaagacagcagaatgatgctcattttgatcaataataacagtctcccgcccctgaaaattttcacacacaataatcactgttaaagctgtttcctttttgtcaaattgaaacattcagtgtgtgggtatgttgcctgatggcatgcaggctcctgataaagtattaatcatgcaactaaatgacctgagtccccaaccacatcatgtaaaataacatcatctctttaaaattaattcattgaaagaaactttaaaaagaagtgtggagaacaaagtagtttatgctgctgcagtgagaccctattataacaggttaacactacagtagtatagaatatacaccaatgctgttggtggtagaagtactccaggaagctaacaagtatctgagcatgcatcaaattccttagctaggagttgcatggatcctctactttctgcttctactttaattcatttattcagtaaatgtctactgagcacctactatgtgacaactggttgcactacttgttggacaacaccctttcactaacatcttacctcttccaatgcattctagacatggctactagatcaatattgtaaaaacacactttgattgtttcataaaccaggctcaaaaacatttgttgacataccactgcctgccaatataatcccaacactttatattacatttagatctctgagtaatatgtttctctccaacattagcttgcacattttcctcactagagtgtaagctctttggttgcagttagttcatttcaatgaaaatttttttgaatatttatcatgaccagtgactgtgctaagcatggggataacatggtgaataagacaggaagaattcttgttatagtggaagagcctgacatgagaaacaaatactctcaatataatgcggttaagggcaataacaaaaccgagcacaggatactcaggaagtacagaggaagtgctcataattcagaccagttgttgaaggaagtcttcttaaaggggtgcaggccccacaccttattcaacttgatgttcccagtgtctagcacaattcttggcacatagtaacttgaataaatacgtaatccttacaatatagtcaatttggaagactcatcttccccagtctgctgtttttctatccctctcctctttgcctagaataccctatttttttttttcacgactatttttgcctttcagaagttcagttcaaatgccacctgctccatgatggctttcctgattactgaaaccagtaaataagcatgaaatcagattatcctctatgagagaaaataactgtaattagttggaaatggttactggccatccccagaagtagctgaaaagaccatctttagtgtgcccctgactttcaaatagagttctctagcctagacctccaccctgagccctacatctgcatattcaactgttaacttggcatttccatttgaatgtcacacaagcaattgaaacacaacaggtcccaaacagaactcattatctttttcattctatttgtctgtttctgttccaatgttttctctaccattgcaatccatccagttgctcaagctagatctgtgggtgtcatctttgaatcactccacacttggtattcgatcagtcgccaagttttattgattctaccccctaaatatttctctccatgttcactgttactgcccactatcacttcttgcctggaatactgcaagagctttctgtctggtctccctgcctccaatcttgtttacttccaaatgccactccaatctgcagccagagtgatcaaaaaatgaaaaattgaacaagtcaggcccatcttcaaaacacttcagcaaattgtaatagcctttagggagaagtgcaaaatcagacaatggcttacaaggcttctcatatttagactcatctctcccccttctctctaccactctcctcattactcatgtattagacttctttcagttcacactgaacaatttctcacatcatagccttcaaccatgctgtttcctctgcctgggacactcttttcttgaatttttatgcggctgattcttatttctcctctagatctcactgcttcagggaggctttcctaataaattaaagatagccatggtcttaatctgttggggcttataacaaagtaccacagactaggcagcttataaagaacagaaatgtatttctaacagttctggaagctgggaagtccaagatcaaggtgctggtagatttggtgtctagtgaaggttcattcctcatagacagcacattcttgctgtgtcatgatggaacaggacatgatggaaggggcaaggcagctctttgggatctcctttaaaaggacactaatcccatcaatgagggctccacatccctggaagaccccccagtcctaaccgtatcacctgtggttaggatttcaataaatgaattttggggcttggggacacaaacattcggaccatagcagtagttaataagataatccatctcattctcctgattctggctccaaacttacctaggaacctctttgtaacaataacaggcttgcctgattatatttttctttatcagagagactatgacattatttacatcttataacaaaaaagaaaattttaaaccccgatattctgatttatgcatcattctgggtaagctgatttagaaaaaacaccttcaccttgtctctccctaactgtataaatcacaactggaaatgatgttccctccctcaccacttttatgtcatttagctcatactatgcctgcccttcttccatacctcaaaacattgcatacatctcatctcctctattaacaagcagatacatgagccttctacatttctgtgtaaatagaatgtgtaggtgctcgatgagtatttgttaactgtagtaaaacacatgaaataatgaaatgacagatctaaccatgttgattctatttcctacctctctatcgcatgtgttcttccttttctaacactattgccactgctgccagactttgatgattctctctggattactgcaacagcatcttactggtacacagtccctctaatgctacattttcctcctcaaggtcagtgtccttaaaacacttcaacaagtttctatttacctcagcataacaaacacattcattaaaatgcttccaaggaccttgatgatctggcccctgctgacctctcaagtccttgtctctctcccctgcccctgttcctatccttcagtcacactgggtctacttgctgtctcttctgtgctctggtctttaataacccacattattgcacattccactggatccacctggaacaaccctgcacccccccgcccctacataatttccaaacatactttaagacacagttctagagacaattctggaaagccttccttgaccctgcctcacgtcacccaggctgccttctcgtctcactttcttagcatctgctgctaacttctatcacagaacttaccatattcgtccatctttctgttcacgtcctcactccttctaacagacaaaactaaaccatgaactcttaaatggtagggaccacatctgtcctgcttacaattgcgtctccaggacatagtataatgcccagtatataccaggtgctcaagacacatttgatgaatgaatgctttagggtgctagtgctctaggcaagggatgggcagttcccagaatattggaatagaacatatccaaatgtgaggtccttggacaataaataagcaaccaaactaggcaccatctaataagtcaaaaacttttattacttgccctcccaacacagtggagtcaggagacaggaaaaagaccacacattttatgttcctagtggtaaaaaataaaaataaaaatagccacagcagcaataacaatcatttattaactgcttactttgggctcaggcactatagtacataccctatgtagattatctcatttaaaattcacagtgattctatgaggtaggtactattaattttttgcagatgagaactttaatgctcagggtggttcgatatgtttcccatggaccgcacaactagtaaatggtagagctttggttcaataccatttctgtctggcttaaaaccccaggcacttaactgctgccctgtattgtccagaaaagagttaaactttaaaacacaaaaacagaaagacggtcatgcacaaacacaacactgctgaggatgcctgtaaggaaaatccagagcataagttcctcaacttgtctccttcctgccacttcctttaaatctgaatgaaagaagcctctaaggagataaactggagaggtcaatgtaccattgcttttctaacatttgagactctgaaaatttactggacagtttccatttaggttgttttttctattttttgctaacatcagctgcaggcttttgtagcaatatggagggggaacactggccacagggatggaggaacttgcctgagtcctcctggggactgagccccagatgtggatgagaggagcaggggtagcaagagaaacttagagtattaagctgttctttcaaagtgagtgctctcctacctgcaccttaaataagccttggcctggcagggacactgcagtcaaatctcaatctctctctctctttcaatcccccctccccgaattttcttaagaagattctcagcatggaccatctcttcagcgatactgttgagtgtgagggtgggcacatattttaattcttcttacccatgcctcgtccttcatattcaactcctatcttccttgactgttttaattttccactttcctttataatttctcactttcacatgccagtaatataccagagattaggtatttatgctgtcacttgggctacaggatttattgtagtagaatgcatttggatgtaggggagaatgtgaaacaattgtagtcacccaggagaaaggtgaccagaattctaaacaaagatttgattctgaaaaaggagactgagaaagtgcagcaaaggccttttttggaaatcttgtttccatattctatgttgcttatgtttcatatgctatcacaatcacaatttaaaaacatgcaaaaaaaaattaagatgctcttaattgagaatagttgctattcagactattgacagagaaatatagatgcatgtgaaatcctgctgcaacagatgatattaaccatcttatgttagatactggcagaagtgagtctagtttgataggggccctcagctgtggattagccatctttgtgtttgtctctctaaagagatggtattttaatagtatttgttataataagaattgtcctgaagcaatcaaaatgtatctagtgttcctgggattgtgctttatggtctatgccttcattatgatcattcatttattaatgtgctaaaaggggaatactttgccattaacagaagaaaatggcaaaaaagggttgtgacattgggcaagcaggcctttaatggagatgggaaagcatcaaatatcctcctttcatttgtcagagataaattcattttcaaatatataccacttcactctattcaaaggtactgaaatagggcatttcttacaggccattttgaacactaattgcatttaaatattggggacgaaatcatttaacctgaactgtatttgtagacaattttaaaacacatttcctctcaagaaaaaatgtaaaaagaaaaatatgtctaacgaatttttaaatgtattagggatgaatactgaaagcaggaatcataaccagaaagagaaatctaaaaagatggaaagaagatagaattaaatctcaaatagctgaattattgggcttagaagttgctatttcagaaagatccattcagcacaaaatgctaataattacagtatatgtctgcctgctcatggttctgtggctacctgtgaccagtcatcattcatatacagacagaagtcagattctactttgctctcttggctgtcttaagcaaattactggcaaagtatgaatgcagagactacaaatgactggaagaagaggtgagtggggaatgataacaagtcagatgaggataagataatcataagaaaagagaagagaaaacatggcaacattttccactcttaaaaatgtctccaccaacctggactttattcctaggtttaaattaatagatacaatgaatatatatcaaaaaggctttaaaatgtacatgacctttgatccagaaattctactttaggaatacctcaggtaaattaataaagatgtggtccaaaacagagttgtaatgaagttcgttgcagcatgatttgttatagcaaaacattggaaacaacttaaaagtatatacaaaaggatttattaaattatggcatgtctataagatggaatattttgctgccactaaaattatgatttctatttttattggcatagaatatgatcattattgttgagaaaaaggattataaaacgacccacagtatgatcccttaaaagtatacatagaaagatgcctgaagaacatacagcattaccagtaattgcctctaaatggtttttattatgggtgctttttatcttttttttttctccttttcctttttcttgttttcattcttttttcttgtttctatgctaagatatttctgccatgaatatacattggttttattaacataaaattgttaggcaggtcacccaagatggccgttcctccaggacccaagatggcagcaccaaccccttctccccccacccccgccccccgcccgcttggaatctcccaccagattttcctgctggacgggcactttcagatgactgcagccccgagaagtcgaaacctatcccagaaaaccgaaacttactaagcccctccccgcgtgctctataaaaaccctctactgccccagtcgggcgcgacttccctggccctccttgttaggaccagtgaacctcgcccgagagctccattaataaagcaggtcgcctctgaccattagtcacctaaattctgtgcggtagttctcattggatacctgtcttcccaagccggacattggtgccaaaacccgggaggagacccctctctgacccagggtcggggagcatctcctctccctacctgccaggaaccagactcgggccagcgcattcggcctttgctattgggtaagtctcccctccgtcctgtaggccccgggaacctctgtctgtaatcgcggccactcagagtcttccccccatcagtttccgactacgggaccgaggacgcggagacgtccgtcctcctcggcctccgccatccgcgcttcaaggaaggttgggggatgcccctccctgaccttgaatcgcccgcctcaggacaatgggaggtgcccaatccaaaattgatcctaagacacccctggggtgtctcctagccaactttgaagctctaggcctcagtatggaccttaagcggaagcgactcattttcttttgcttggtcgcttggccgcaatacaaattggacaaccaatctcggtggccgccggaaggaactttcgatttccaaattttacaggacctagacaacctttgcagaagacaaggcaaatggtcagaggtcccttatgtacaagccttttgggacctacgctctcgtcctgacctatgtgccaagtgttcccttggacaggtgttactggctaaggcatccccctctaacaaagaacctgattcctcccctctctccgagcctcctgaagccctcgctttaccaccattgccagcggcgctccctcctccctatccaggatcctctggccccaccccaacggctcctccgctacctcctacaccaccttcctctcccgctaaccctcccgcttctgctctgccaccgccttcccctgtatctgcgcacactcggtcgaagacggacctcttgtgtctgctccgtgaagttgccggtgcggaaggcgtggtcagggtccatgttcccttttctcttactgacttatctaaaatagagaagcggcctgggtccttctctgccaacccaaccctgtatatcaaacaatttaggtacctatgccaggcttatgacctcacctggcgtgacctacatattatcctaacatccactctgtccccagaggagagggagcgagtccaggcggtggctaggcaacatgccgaccaaattcatttaactgaccccgccatgcctgtcggaaccctagcagtaccggcagccgagccggactgggattaccaagctggtcagactggccgtcgacgccgtgaccaaatggttcagtgccttctggcaagcatgcaggcggcttccaataagacggtcaactttgacaaattacgggagattattcaagggtctgacgagaacccagcagttttccttaactgccttactgaggccctcatccagtatacccgccttgatcccacctccccggcaggggccactgtcttggctactcatgtcatttcccaatcagcgggagatattcggaaaaaactaaaaaaggtggaggaaggccctcaaaccccaatacaggacctagttaaaatggccttcagggtctataattccagggaggagacggctgaggcccaaagacaggcaaggctaaagcagaaggtacagttccagacccaggccttggtagctgccccgcggctggccggctccgggagccaaccgaaagggggttccggccaccgagcgccacctggtgcctgcttcaagtgtgggaacgaaggccactgggcctgacaatgcccgtaccctaaggaaccgacccgaccatgccctaactgccaccagatgggacattggaagtctgagtgccccagcgtcggagcgtccacagtgcctctacgctgtgaaaactccgagacgaccggtggcgccttccaattactcagcatggacgacgactgaagaggcccagactcgggaacccccctcactcttgccgagcccagggtaacgctccaggtagcaggtaagtccatatcttttctcgtgcatatgggggctacctattctgttttgccttccttcggcgtgtccagtttcccgtccccggtcacggtagtggggattgacggtaccccttccacccatcgtcagaccccccccccattgtcttgccggctggacgacactctcatctcccattccttcctcattatcccttcctgtcccgtcctgctcttcggaagggacttgctgtctaagttaggggcctccattcggttgcaccccagcctcccctccagtgcaatctctttgcttcctctgctggcacttagcgatgacactccttcgccgatcccattgctccctgtgcccgttgatccaatagtatgggacatctcaaccccctccatcgcccgacaccatgccccaataatgatcaaactcaaggaccctaccaaatttccctcgcggccacaattccccatctcagttgaacaccgccaagggttaaaacctatcatcaccaggctcttgcaacaacacatccttatcccggtaaactcccgttgcaacacgcccattctgcccatccgtaaggcctctggtgcgtaccgtttagtgcaagatcttcgcatcatcaacgaggctgtcgtccccatttttcctgtagtgcctaacccatacactctcctatcccgcattcctccgaccaccacccatttcacggtccttgacctcaaagatgatttcttcactatccccctccaccctgactgttacttcctgttcgctttcacctgggaagaccctgacacccatgtctcctcgcaatttgcctggaccgttctcccgcaaggcttccgagacagccctcacctctttggacaggctctagctaaagacctcagtacatgcactttggccgacagcacccttctcctgtatgttgatgaccttctcctttgcagtccttccctgtctgtctcgcagcaagatacagccacaatccttaatttcttaggaaaacaagggtatcgagttacccctcacaaagttcagctctgcaccccgacagtcacatacctaggcatttctctcaccgccaccaccaaaagcctcaccacagaccgagttagcctcattaaagacctccaacttccccaggacgcagataagatcctctccttcgtagggctagtagggttcttccggcactggatcccaaacttcggggtcttagctaagcccctgtaccaggcggcgaaagaaacacccaccagccctctgtctgatcccgccctagtggcccgccatttccaccggctgcagcagtgcttactcacagctccagttgtatccctgccgaaccccctgcggccttttcatctctacacagatgaactgcagggagttgctactggcctactagggcaaccggtaggacccacctatcaggtggtggcttacctttccaggcagcttgatcccagcactcggggctggcagccctgcctgcgggccttagcagcggcggcagagcttaccaaagaggccctcaaacttactctcagtcacccactcacagtatactccccgcaccgcttgacagatgtactctctcacaaatgtctggcccatctggcgccctccagaatacagctgtttcatgtgctctttgtcgaaaacccagatatcaccctgaccgcctcaccacctcttaaccctgctacacttcttcccatagaagcctctgagccccctcctgtcctgtcgcattcttgtcccgaactccttacctctaaccccaactcccgacttggcctcttcgatcgaccgctttctaatcctgacagcactctgtttgtcgatggcagctcagtcctcaccccttgcggtaggcgacaggcagcttacgccgtagtcacccacgacaaaacagtggaggcggcagccctaccccttgggaccacttcgcagaaggctgaactccttgctcttaccagggctctactcctctctcagggacagcgggtcaacatttacactgactccaagtatgcgtattctcattgcacacacgcattctgttctctggcaggagcgaggtttccttactatgaaagggacttcaatcgtcaacgggcctcttatccataaacccttaaatgccttacaggcgccccgagaggtggcgatcatacactgcaaaagtcaccagcactcaaaagaccctgttgctcaaggaaataatctagccgactctactgctaagtctcttgctcttacttctgcccctgccccagctcccgcaatgttcctgtccggttcacgcacccctgcctattctccacaggagaccttccacctcatttccaacttaaaaggaatgaccgaccaagacggttgaatctgggtcgataaccggattgccctccccgaatcccaggctcaggctattattaccgatgtgcacaagaccctactcataggcccaaaactcttacatcagttcttagaaccaatttttctatgccccggcctacagtccctcattcaccaggtacaccaaacctgtgctgtctgttcaacagtcaacacacaaggaggacttaggcgcccagggccccatcaccagctccgcgggcatcagccaggagaggactggcagctagatttcacccacatgccgcggcacaagcattaccgctaccttcttactcttgtagataccttcacaggctggattgaggcctttcccactgcacgtgagacaggagaagtcgcagtctctgtcctgctagaacatatcatccctcgctttggacttccccgatccctgcaatcagacaacggccccgcgttcgtctcaaaaatcactcagcaagtatccgagtcgctccgcgtcacatggaagctccatatcccttaccgccctcaatcctctggtaaagtagaaagggctaacagcctcctcaaagaacaccttacaaaacttactcttgaaacaaagctgtcgtgggtcaccctcctaccattggccctgacccgcctccgggcagctcccaggggccccacagggctcagccccttcgaacttctctacggacgccccttcctacttcctggtcttccccccactgtttcgccccctcccctcgcgtcctatcttccttatctgaccctccttcgcgaccttctccgcaagcacgcggacgcctgcctccccgaacctaccccctcctccccggacgcccctgttgtgctctctccaggtgatagtgtcctccttaaggaactacagtccaagaccttgaccccgcggtggtcaggcccttacaccgtgatcctcaccactccgagggccactaagttactaggtctaccatcctggtatcatttgtcacagttgaagaaagcaccgactcagcacgactggtcctcaaaactcaccccaacccggcttcgtatcacccatggccagaccttccccactatgcctcctactcctcctgaccctcctaacccccatagtgcccagtaactccctcctaactgaacccccgttccgatggaggttctacctgcatgagacttggacccaaggcaaccggctctccactgtcacactggcaacggtggactgccaacctcacggttgtcaggcccaagtaacttttaacttcacttcctttaaaagtgttctgcggggctggtccaatcccaccatctgctttgtctatgatcaaacacacagcaactgccgcgactattgggtggacacaaacggaggatgcccctatgcctattgtcgtatgcatgtgacccagctccataccgccaagaaactccaacacacctatcgcctgacatctgatggaaggacaacttacttcctgaccatcccagacccatgggattctcggtgggtcagtggagtcactggtcgactgtaccggtggcccaccgactcctacccagttggcaaactccggatattcctgacttatatacgagttatcccccaggttttgtctaatttaaaggaccaagcagacaacattaagcatcaggaagaggtcatcaatactttggtgcagtcccatccgaaggctgacatggtcacctatgatgacaaggctgaggcaggaccgttttcatggataaccctagtccgccacggggctcgccttgttaatatggcaggcctagttaatctctcccactgtttcctttgcaccgccctcagccaaccaccactagtagctgtacccctaccccaggcttttaacacctctggtaaccacactgcccacccttccggcgtcttctctgagcaggtccctcttttccgagaccccctccagccccagttccccttctgctacaccactcctaactcatcctggtgcaaccagacctattctggctccctatctaacctctctgcaccggcaggtggctacttctggtgtaacttcacccttacaaaacatcttaatatttcctctaacaataccctttctagaaacttatgcctccccatctctctggtgcctcgactcactctgtacagcgaggctgaactctcttcccttgtcaacccgcctatgcgtcagaagcgggccgttttcccaccgctggtaataggtgtctccttgacctcctcacttgttgcctccgggctgggcacaggtgctattgtacatttcataagctcttcccaagatctctctattaagctccagatggccatcgaagcctcagccgaatccttagcctctctacagagacagattacgtctgtggccaaggtggccatgcagaaccggagagccctagatctcctcacagccgacaaaggcggaacctgcatgtttctcggggaagagtgctgttattacatcaatgaatcaggcttagtagaaaccagcctcctcacccttgataaaatccgggacggtctccatcgaccctcctcaactcccaactatggaggagggtggtggcaatcccctttaaccacttggattatccctttcataagccccatcctaatcatttgccttttacttctcatagccccctgtgtcctcaagttcatcaaaaaccgcatcagcgaagtctcccgggtgacggtcaaccaaatgttactacacccttactcccgtcttccgacctccgaagaccactatgacgacgccctcactcagcaggaagcagccagatgattacgtcgcccctttttcttacagtatgaggtcggaatgttaggcaggtcacccaagatggctgttcccccaggacccaagatggcggcacgaaccccttcttccccgccccccccaccgcttggagtctcccaccagattttcccgcccgacgggcactttccgatgacagcagccccgagaagtcgaaacctatcccagaaaaccgaaacttactaagcccctccccacacgctctataaaaaccctctactgccccagtcgggtgcgacttccctggccctccttgttaggaccagtgaacctcgcccgagagctccattaataaagcaggtcgcctctgaccattagttacctaaattctgtgcggcacttctcattggatacctgtcttcccaagccggacaaaaatgaataaaacaaaatttgttttcgaatggtttagttgccaaggcaacactagttccagaaactcagaatgcccctttgtatgattatgtgcaagtacatacctccgttgagcctcagtttactcatttgtgatatggaataaaagcacctattttacaaggttgctgagaggattcgataagaccaagtgcgtcaaagtggctggcacaatgctcagcatattgatgagttcagtaaacaccgagtctacaactgaataataggtcaataatctgtatttcacatgagcatcaataaactagaagatttgtatattctattatttagatagtgagggaaatctgttcttcaaacataaacaaggtaggttccaacatggggtatagcgaggctactcttactctgtgtcttgagactttgtggaatgtgaagatttggaagggcgtggccagacaagctaagattaatccaagcacctacttcaccagcagacaccagagcccacgacctccctcatatgagtgcaaagacagagtagtacaacaacacatggtttgctcattccttgttaaaatggaaaatgtcaactaaaaataattttctttaaatactaccattaacaaaacccaagagttttgagcaaacagatgtttaaaaagaaacttattttctaaagtgtaactgggacaatgtaaccagccaaattgctatatattcagttgccaagacactgatattggcaagttctatattgctctctattggtagatggaagaaactccagataatgaatgaagagcaaatggcacttctgaactagagcagagtggtttccttagtcatttaacaaatatttatagagcatgtaaatatttggaatgctctggtaggcactaatggcaatgggattaggacccctgccctcaaggaatttcacatgagaaaggtgaattaaagtagattagctatcaagaaacctcagttccatttaatgttctgtttaagagtgacttgcatatgtcacacaacaacgcagtgccttggtttctcaatttttaaaatatggaaaactatattgcttttcttgaggactaaatatatgaagaatttgaaattgtttcaagcttttgctggaaaaagctttttttggaaaatactgagattttttttccaggcaatattataagaaaatgcagtattttcctttatccttgtttcttccttgagaagtcttagaaattaccaacaacagcaacaacaacaacaacaacaacaacaacaacaacaaatgctccaatttttaaatcggttaatcttcatttgaagggttttttcttctctttattttttcattttacagtctgttcatctttagccctcatgtgtatatttaaatacatcattgtggaattgcaaatgtgtagtttgtttatttctctttgctcccaaattgctccccaatccagtttatttttcaaaagcaatttaaaggtgcatctttcagtgggttaatctaggcaatctgtttgttggttctgttctctcaactgttgagtaatagttattggattattcaaaagggagagagttggcttatttcaaataacatgggcaagattctcgtttcacatggttgtgccagtgcacctgacaacccaccagcaacacattcctttctccatactctggcatctcttggctaccctccactgagccaggtccaacagacttcattgatgactcagtgaagaacataaacatatatttggctaaaaacaggggtgaaattcatcttttaaaattttaagtaaggtccaaattgtagtttacaaaaataaaagtctaatattttagttcatgtattcataattccatatggtggccaacaggtccaacatactgtgacttccacctccctgactgtccttaacttggattactctctcgcttgcccattacgcttaagtcacactgtctttctgtttctggaacacaccaagctcatttcctctccagggcctttgctcattacacttgttcccttttcctggaatggtctcctcttcttcctcaaattaccccctatgccccattatcaatttaacacctacttatcctacagctcttagcccaaacgtcattttctctggaaggactttcctgactttccagatcaagttctcctcttacatttttatgaactggaagaaagccagtgtagcttcagcatatgatacaagagtggcagtggtgcaaatacctgacactgggtgatttataaagaaaagaggcttaactgactcacagttcagcatggctggggaggcatcaggaagcttacaatcatggtggaaggcacctcttcacggggtggcaggagagagaatgagaattgagtgaagggggaaaccttttataaaaccatcagatctcatgacaactcactcactatcatgagaactcactcagtatcatgagaacagtttgggggaaactgcctccttgattcaattatctccacctggtcctgcacttgacacgtggggattattacagttaaaggtgaaaatgggtggggacacagagacaaaccatatcagagagataggcaggagacagaccaagcagggccttgtagaactaggtgacactttagttagtaatagtgtaggaacagtggaaagccattcaagagagtgatcatatttgtgttttgaaaaggtcactgtgtctactctatggagaatctgcttaaatatgggaaatggggggtacaaaaggaaaccagttaggaggccatttgcggtagtctagggaggagaaaatggagacttggaccagggtggtgaccatggaggtagggtgaagttagtaaatgccagacatattcacaaagtaaattaataaatcttaatggattagatttggagagtgaaggagaaggtggtgtccaagatgataccctgtcctgggttgggcagttagatggatggtagaagagtagctcttaaaggtatgtgaccgtgtgtggtgggggtagggtgggaagttggagaggacagtggtaatgctgtgggctggctctagattttagttttaaactaaagtttgtaaagtgcttagtagaatgctttattatactattacagcgtcataataattatagcttatacttactgaacatgtacttgtgccaggcactgttttacatgctgcacatatattaagtcacttagacatcaataaatgataatgtttatgattccataattatcattatcattattgcaatatatagtgcctgtctttctggacagagttagataacacaagcaatttctttctagccaattctcctttttatagacttcatgcaggcaactaccacagagtataggcacattcttcagataagttaacaatgcaattgatgagattatacctttatttagatcttttctaaccctgagggaccgggcatttcccaggtgtgtaactcatctaaaagtctgtactcagagtgggctattttagtctgactgttggtttctattatcttcattcttataaagtgattatatctgacattaccctgaaataattttttgtggctatttactaaagccacatatgtactgactagagtattcttgcccaatctaggacaaagagcttgatggggttaaaaattaaatctcaactttttggaaaatccactcaactgagaccaaactggcagtatttttattttattttatttttttaaattcagttttataaactgaaggcagaaagcctcttagagctgtcctctgacctacatgctgagaagtcaggggcatcaaaatgcttatgtatagctcatttggggggaacttgcaaactagctggactagtttattctgatgaaattatcaaggtctgagaagtttacacaggtattctggaaattgattcaaattggcaggttacatgttgatatcgctttaaatcattagcactgcctttgccttatttgggaatagatctgtatttgtctgttaagaaaggaattaaaaaagagacaatgttgtttttattgtgcaagataacatcgtcatcagctattcattgcactgaacaagcaacagtgtgtcttcctctttcacctcgattttaggtggaaacacttaggcaaacaaacaaacaaacaaaaagtggcattagagatggtcttccaattttcttggagacattaaacatggaagcataaattaccgtaaaggcttgtgaccacttcatttggtttcaaaatctattgatgtgatcccagaactttaaatgttgtcaagggtaaggaaacagaaaagtaggcatgactaaaataactaacacactgaagtgataagtgagatttgagatgcagtacagtccatggagttcagctcaggctcactaggcacattcaccccccgtttataaaacaatcaggaaaaacctcctgtaaatgagggactgccaaagaagacacttgttgggatttctatgcaaggaaagctcctcgattcacagaggagaagatgatacaggaggctgagtaactatagctgccaaaaaacaggataaatagcaagtcacaattggactctttgcaacatacagcaacaggaaaagctgccttattctcttcctgatggcagtggcaccttggagctactcactccaccaggggagaaagctgatggagcccaagaggcagcctgtgcccttgctcttaagttgatttgcccagccaggcaaatgcacgtgggaggtttgactttgtcgttcacactggtccagatggtgctgtccaaaaccagaatctctgggccattggagcagcatggagaagctttcagctccccctgaatcaaattctggctcttgcagcaggcaagtcatggaagagtgccaaactttccagccaaaaagctcctgaattctctttctttcttactttcatccaagtcttcctttgaaatattagagttgtaaaatgtgagttttaaaaaagaagcttcttttcattttaaagactatttctgatgccttgaatcatgacatcaccagaaattaagtcttaaaataaaggaagctcttaatttacattttccttcaaactgcagttgatttagaaataaatgcctgtgctggaaatgcagagtacagcttgtaaatgatttttttaactgataagctcatcataattttatatggcttgccaactggtactagctgagccctgtcactggaacagggtttacaagtgaccctttcataccataccataagggttttaattcacaacttgcagaactgccttcgcctcccttttgatcctgtgtactttgtattatgtctggatgatcatctctaccagacaataagctcctttgagggcaggggctgtgccttagtcatttttgtatctctctactctccctcctcccaacccagcctagtgctttgcagagtaaatactttaaaatgtttgccaaatataggcaacattttattctagtcacttatgtcaccctgtacggcaacttgatgtttttttattttttaatctcgcatcacaagctaagagagttaggtggttttctgtagtgcagcccaaagcgatatctcagaaacagagtcctgtaaatcagatagagaagggatagaaaaagtgctatcaggtggttcaggctggtgcctaattttcattaagttcattgccacattctcttgacaactttaaggtctgggcttctgaggaaagacccattttcttgtttgggaagagaaattatcactactattatttcacttgtcaaaattaagtaaaatatttatcacttttgtgaacatcaccattatgcagagaacctccatgagccatacaggcttttctttagcccagattcaggtgtcacctctttgaagaagccttctgtgattgttctggcctgtgtttatttgtctcttctgtaaccatttatagcactgtacagcatactttggaatttaatagactaccaatattgcaagctcttgagggcagagctgtctacttttttcattccctcaacatctcctaacatggggatagattctatagtagccaatacttcatgcatacgactctggaatctattattctcagcctaccatctctatcatgcactagtcctcctgatagttccatttggatgacctcacattatttccaatccaacatacttacaatgaactcatacatttccttaaaactagcttctcaattccttagtttctttgagccacctaggccttaaacatcactgtaacctttgactctcctcccccttcctttttcttcacatctaatcatatctctagaatgcttgcctctcaatttttttcttcccatttctacctgctgccaactccctaatccatcctttatcatctcacacttagactactgcagtaatctaatcttaagtctcaactttacaccctgaaatcacctcttcgccactagatttattttcctaaaactctgcaagaatatatttttcttgctcagaattttgcttgtaattgttcctcaagtggcttgtcactaccttcaaagttgaaggccaaactccttggcttggcttcaaggatattctacatatagcctgaaacaaacaacttttcttttcttttcttttttttcttttcttcctgtctctttctccttccttccttccttccttccttccttccttccttccttccttccttccttccttcctctctctctctttctttcttttcctttttttttttttttttaaccacaaagtctcactttgttgcccaggctggagtgcaatggcgtgatcccagctcactgcaacctccacctcccagagctcaagggatcttcccacctcagcctcctgagtagctgggaccccaggcgcatgccaccatgcccagctaattttcatgttttttggtagagacaggatttcgccacgatggctaggctggtctcgaactcctgacctcaggtgatccacctgccttgtcctcccaaagtgctgggattacaggtgtgagccactgcgcccagcccaatatttctaaatatatctcatgattccctggtaagaaccaaatgaatctaattaatgttctaaaatatgctctgcatattcccttgattatacttttgtttctgttgtttattctgttaggaatgttattcatcttcctctgccaatataattatctgttcttttagatgcaactccagagttaaacacaatccttggcacaataatgatctactgaatgaatgtgtagactcaagtcccacttcatctagaaatcattcctactcacttgagcccataatgatttttttttttccttttagggtttatgttacatgattatctccactaataatttggcacttggcaaatttccctcctattgtttaatttgaatatgtctttctagccaactgtatactaaactccttttggttaagtattctatcttttacattttatacctctcacttagccagttgcagaatctcatgtgtagtcagctgacaatatacatgttctcttagtctgtttggtgttgctaaaaaggaatacctgaggctgggtcatttataaagaaaagtagcttatttagctcatgtttctgctggctagaaagttcaagatttggcatcaggtgagagccttaggcttctcccactcatgaagaaaggggaagggatccagcatgtgcagagatcaaatggcaaaagaagaaacaagagagaggggctaggctctgtttaacaaccaggtcttctgggaaggaatagagtgggaactaactcattgctccctgccctcacaaacagggagagcattaatctattcatgatctaaccccatgacccacatatctcccactaggccccacctccaacattggggatcaaatttcaacatgagatttggagaggacaaacatccaaactatagcacctgtgtagattactcacaggtgctcaacaaattgttgttgtcaaatcaaatatggaagtagggatagtaatactgactgaaactttttagtcttcttgtctcctgttaattgatttactcctctccttcagagcctttatatttttaaagtcaaaattgatagtatttaacaatgttttgctgcagcctttaattttcccaggcttttaaggtaatagacttctgagatgatattatatgaatatctttagattatatatgatgaaatacagcaaaagttaaacttacactactggaagaaacaacaacaacagcaacaacaacactaatggactacagcatagttgaccttgtacttcagtgacctttgatgactaaacaatgtatcagtttgatcatttacaaatcgtcaagacggtaaaaatgaaacaaatcaaccctaccaatcttatctgccatgcaaattgtaaaacagcagaacacgtccaatctttgtaattatgtatctgaataaaaagtgaaactatagttaatgcctaaaatgctttgtgtagattttggatacatcaagagggatggcaactcccctgctcatatatagctaaggacacacagcttcaaggtatccatttaatcttcactttgaaaatagatgttattaatttcaatgagtacatatgccctgtaaacaattagaaatatcagtaagactaagtatgattcattattaagggagagtctagtgaggaaagggaaagtaagacaatgtattgcaaactttttagaataggtgatccttaatactcatttcctgttatttttataaatatctaagaaacatttcagctgatgcaaagaacagtaataaaggtacaatgtggcaaagtttaaggactcaaatgtgcgcccatcatatgaaattctagaattcttagtttataatttaaataggtgcgtatgtgtgtgaatatgtgagtgtgtctgtgtgtgtgtaatttgttttcatgcttacaagaaaaagagagaaagaaaaggtaaaacagcaaaaagatcttagtcattgtgcatttggttgtaaataatataaatccactaaaattagtataaataaaaaagtggaatttgttgtaagaaacagagaatctcaaggaaaccggattgaaagagtagtttggtcttcatgagaaactggaaacaatggctggaaagctgtcaagaaactgggcaacttctctctcttttacccctctctctccagattgactttcatgatatcagcaaatacaaaaacctagacttctttacagcctctgaatttctatgttctcagttcaactgaacagcagaggctgagtcacaatctctgaattacaagtccaaattcctaagagaaggatgtgattggtacactttgaagtaaatgtttaccttaacctgatcagctatggtttaggggagggcccaaaagaaaaatcagcacagcttaggtcaaatgttaccacatgtccaatcatctttggctcagaggcagagatggtatcatataaatggtacatacacagcacctgaagttcatccctgttgaaggattgtgggaaatggagtcatgggattggcagacaccctaaaaaaatgaatataatggccagtgacaggggatagtaaagagggaggagagatagaaaagaaggaagagggagacatttaaccatcttactgttatacagtcatttatttttgatatatttaatacacaatccagggcaattgctatttcttattgttttattatttattgttactattctgcttacattatctgataaactttttaaaacctcatacgctaataatttatgcataattataattcactggcagtttattttacacgtaatctaattttccattctaaataaaacatctaaatgaaaacttaaataggtgttttatatactcattaacagagtatgtaaaaatcaagatggtgcctagaatcctgtatgcagtgccctacttcggtgaggcagagtttatcaattaacatgcagtttccttacattaaaaaagaaatgttcatatctattagctggaattaaaaaggcatatttgtaagataaaatagttttgcatatagttctgtagcatctatattttactatgcttgtatttgaaagtgctaacttttccttcagattcattagaagtgtattttaaattaaccgaattgttgcatcttttttttttttaaacaatatcctctatgagttttgtcactaggtgttgaattttactagctctgtcagtcttacggaacagttaaactatctggcctaatgggttaggtggctgtgacctgtggttacagaggggctgtgaggctggcaaaagctagattggtaggagttaatagaacaaataatttttaaaaattagggaaaatagctttacattataaaatacattcaaatgtaaatatgtattgagaagagggcagatatgcaaatgagactttttggcagagtgtgggggtgaggatgaagtggttgcactgaggcactccgctttattcatcttaaccaggttagtgatgtggaaaaagtcctgggctagaagttaagggatccgggttctagctcataatgcagtgtttacgggctgtgtgactttgggcaacttacttgtattccttgagccccagtttcctcactgacaaaatgagatggttggacaaaagggtctctaaggtgcctttcagcaatttgatcctatgacctaacatgattcatagaactgtgattctcaattctgctaatccatgcaatttcttcctgtcaagggttagtatcaacaattgatgtgactcatgatacctataaaaagactgtttagcttgtatgtctcctttcttttccctgaggttgcatattatgttcatgctgccctggtttcgccttggtgatgagaaaggaattccattttcaggaagaagctgagggaggctgggtgccttctgatgaatgggaagccatggaaagggcagcagcctggaaaacattcagttccaccattttcttttctggcaagctgcattatcccagtccctggtgttaaatcagggactggcataatacaagtttgacaattgagcaggaaagaaatgcaaactaaaggcgacggggttatcaggcagttccctcttcactccatctcaggcaagcttcagcatcgaagaaaaggttgaaagtgtgtggcaatttataacttggagatagaagaattcattttctaatagggaagctaaattatatgtaaaaaagaaacttttattaaagcagttccatcagagtgactctgattaagaagtagagcaattttcatcatgtaaattatgtttttaaattagatttaaataacatagtaatacttttattcatgttatccaccatttaaaagaaataaataatttggtcaactccctgcattttcacgaagcaaaattccattacaattcttgagtaattgaaactgtggtgatttgtagaaccatccaattacaggaattcagtgcaattatttttctaataaagttagttttcacttacatgtgtctgtcatttcctgtgagtgtgcgaatgctttaaaaatctttttcagatgagccctggatattattgtacctgtagagagatatttattcatactgtcagataaatgtagagcccataaaggaaggcatgattataaattttagtatgtctacttgtctttgtttttctgccagcatcaataaacaattgtgaatgtttttcagtaacctattgaccatagcacattgagtggaagtctggaattttaaaaataattaaattgaaatgttaatgccgacatattctatttagacagtaatgctgtagtaaagattagattaaactgggccagcgcctcttagcattctaataattatgtccttccctgttttcacagaatgaaagttgaggtaattcaggccaatgtgattgccaggctttgccctctattcacccttaactgtagttttaggattggagaaaagtataagagcatcagaaaaatttaatatgcaattaattatttaactgatccttctacagacatttgctcagtgagcccacatatgtcccagatactgcgctaggccacggagatactgagattaattgacctcatgtcaactctcaaggaggtcacaaatccggaagtctctgcacaatacagaatagtaaagttgcagactagcagtgaagtgggtaaaggagggcagggggataggagaaacttgcgacatttcccacctcagcaaagtcagtttggtgactggggtccacaatgaataaatgttattttggaaaaatggcttctttcttctagagtctcttgctccctttaactataaggggttaatttcttcatctctcaggagtgagaggtggacaaaaagtagagcgtgactcggaaggagaaagagagagagaaatcaacttatttaagaccaaaaccatgcttttaaactacggacccctgtgtagagttattataagtctaatattgctctactgtatatctaaaggtttggatcacttttagtttaatgacaaagtctatgttttaaaaggtcagccaatgaattaaacatgtgtgtggtagatttttgcattgctctaccatttcaaagatacaatccagtggagaaggcaatgtgcttgatgtacaatgaaatcaggttttgtcgacaatttgtacagcttaaaaggagagaaaagtgagctgttttctaggtgtaaaggtaagctgcagttacacaattaaaaaatagttgtcttcaaagtaaaatacacacttaactaaggcaaaattatggctaccagtgcatgggtgaaacaaacagaaacacactgatctatacattaaatgcaactctttgaactgaatcccattgtgcaggtagagggttgtgtgtgaggaagattggtttctgttgagtgtgttctgaagtggacaaggagaggagtcttgacatcaacaggccaaagaaaccagatttatgagaaacactgggttgtaaaggtctggccaagaaatgattgtcagtgaatcatctgctgatgaccaagaaaatcaggagagttcatttgaacaatatcaggtggcttgaaaatacgacataatgtcagaatagcttcagatattacatactactaaggaagggatttcagtgaggttccacatagcctggttaaaaaaacccttttactttaacatccttatcaatgatcaagggacattcattacatttatagctgacagtgaattaagttttattttttacaaacaccacagagaacaaagaattgccaggttagaaacatggtagaaagacaaaaagcatggcctcacctgggtaggtttagaataaataccatggatggaaatagaatgcttgtagacactgagtggtaaacaatgaaatataagtcatatcttcctctatctggcccctgccaattccttttctgaacagcagcagcagcagcagcagcagcagcagcagtaacaaccacaacagcagcaaaaacaatgccagcaataaaaaaaatttaaggatggtttcctcaaatatgcagaaaggcagcattaaagcgtaagaaaaataaagtccaagtagtaaacccacaatataggagtatttgagagtgtctgtacaaaaggcaccgctcccaaaacagtgcttggatcagagggccggtctacgatacaaaatatgtgaaatcagggaggcttttccttagcatttccaagaactgttttagagaagattaacaaaggggattgtctggatctgcattgctgttttacaagagattagagagtgaattcaactagcaagagtggcccattctccgaaataggccttaccaataaaggaattatcaatcattttcacctcattcgtgccagagtcacagcagtgaaaaaatgtcccctcataaaatctcaagcctttcacaaacatgctattttaattaccacaatctaaattttcatccgtgtcctcagagagttaacattccaatatgggaactttaaggaggaaaacacttcagctgtattttgaagtccatggagagtagtagataaatagcttacaatggccaattctttgtgcaggagggtgtgggcagcttaaaaatggagctcgcagagcaaattggtactctcttttggaggtaaagtgctcatatgtttaaggtaatttacctcttccaagaagaccattttgctctctgaaggaataatttagttcaaaagggtacaaattcagcatcattaaggctttgaggagctacattttctattataagcaaatcctggagaagctaatttgcctgaattagatgatcactttgaatccaggagggagtatattttacttaccttactcatagtcatcagttttctttcgattgcccaggtgtgcatgaacatgtgttatgtattatatacaagcttaataaaataagacccaatccctttttctaagtagcatatgttcagctgtatcttagcacatgtcccagtcactggtaaacgtggatatacagaatatgattcttcattaaaaggagtttatgaagttttaatttttgacaggaaggcgcctagggtagacaatagaacagagctggcctaactctcatggatgtggtaaggactgacttttaacagctatgaaagtactttcaatattaagccttatggaaccactaattacatttattatttaaaaggcataatgggaagaaataaaaccaagaaaattttagggaaaatatctagaattagtgcctaataagcagcttttttgatggctaaagagtaggtgaaggctactggtagaaaatctattactgcagtgacttaaaatgggaatacaggaaatgtgctggagcaaagtgaaaatcattagggtgctgcaatttaaacattaggcagtgaccatctggccacccttttggccccttggttcataacctgtcaataaatctcacattaatcgacacttatcgtgctttgcctatagaacgatcgaagcagctgtgttattcttttcacagcccttcttacttaaagtgtatcactgcacttcacctgcaaatggaaggaacactattttgtttgcttatgacccaagtcacttgtcaaacctattgtagacttccatacattggagatctgtaagaaaggtgctgtaaggattgagatgcaaatcaaagagtagcttatttcaaaccaaaggaattatagttttattatatatcaatgcattatacctaagacattttctacccgaagtaaaagaattgacctcaaaggataaccaccaacagccaaacacctgactactaccacaacaaaaccgtatctagctatattttaatttggcttcatttacttcatgcaatatcttatacgcattcaggaaattagatgaagagaaaaatctctttgatgcctgactttttaaaaatcatttcactctgtggggttgtatacaacaggcaacaattattttggtaacctaatcacaaatgttcatttttttttaatgttagtctttataaggtaactttaagaatctttaaatactgtctttaagcactgttagaaatctacttgccgatcacagaacatgtttgttgtctgaaaacagggaattagcttcgtcaaaatacatcaaacctaattctggtacttcttttgtggagaagtccaagggtctatgacccagcaatgttggcatagaaagatactttatttgtgtagctgacttcttggcagttctaataaaacctgagtttaaaatgcagttaattcttgttatttgtggtagttatgttttataaagtactgaaccattgcttttagaagaaacgtaaggttaggttcctataagcttctggtcacattgttgttaactaatcaatatgtaactttgttttatgtgtgtttctgtttagcacattctatttaacagattctggctaggcgtggtggctcatgcctgcaatctcagcactttgggaggctgaggtgggtggatgtcctgaggtcgggagttcaagaccaacctggctaacatggtgaaaccctgtctctactaaaaatacaaaattagctgggcatggtggcacgcgcctgtaatcccagctactcaggaggctgaggcaggagaatcgcttgaacccaggaggcagaggttgcagtgagctgagattgtgccattgcactccaggctgggtgacagagtgagagtccatctccaaaacaaaacaaaacacaacaaaacaaaaaacaaaaaagaaaccatattctgttgtttcattaaccctggactcatggcccacagcactactatttatgcctgaatgatgcttgttaacatgttgtcttttttttttttttttttgtaaaaaaacatcacacacagacttcttgtgcttaggaacacttgatggtacttcagcactacgcttgggggccgttttaaactgttaaaatcatccccccagaaaaacgaaaaatgtggcaccaaacagaccacaaaagggacattggtttacaatatgagacctgaaacaagaaggcagagtgttcccttgtttaatttcagcagggaatatgcacgttggacaacttcaattttttgccattccgtgcatgttcacgaatgaccatgaagacaacacagatgttgattgtggggttacaaataaaatttcagcaagcaggcataattcataagtttggaatctgcaaatattgaagactgactgtacctattatgcagtaatgattttttatacttcttatttaaaactgattaaaaatgtattctttacttgcaaagaataaattagaaatacatacgattttgacttagtacttaagtttcaaattttgcccttgaacatttatttcagtaaattaacttgaaaataaggtttgattttctccaaagttagtctaacaattgtagttatttcagtggccctattcaggagctcagtagctaagagattataaattacaaaaatacatgggaaggcaataacaggaaaagaaatcaaggaacaaaatacatgttctcagtattacagtcgatagaaagttcaaagagctgagatgtgcttaatcaacacttgttgaaggaacttgacaatttatattttattttataatttataattgaaaatggtatgagaagcaggatggatggaaacatttatttgaagataataataccattaaggtaactccatgacatactacattgccattatttggaccatgctttatatagcctcaattctgaagtgcctagtgttggccaatatttaagacatgagcatttgattccctataaaataaaaatggtctaacagacattttataaagtgtgctctgttgaaatgtatcattctgtgctgccaggagagcatgcactttgaattgaaagggagtgagaagaaaatagggaatgacttatgcatggtgctttcaagctcacaacagaaatagctctagcaaatgtggtcactcaagaaagttcaaaggtgctggtgtctgagtttgggaagggaggagaagaactataaagctaagatgacatttcaattaaaacttttaaaatataaaataactaatgtgtgaaattcactgtaaatggaggaggaaaagcaaaacctgggtgtttaaaaacaaaagaatagaatagcactagcacacgagaacacagaaagtcacattaaacaggaagatagaagtgtgcattattatcttttctacagtggcaagttcaaacatcagctgggaagagatgagagtgatttgatctctctcttatcttggctttattatatgaaactatgtaacctctttcctgtcttgtgtttttgccttcagtctgtggcttcatacaacgggtttatcttctaggccacatttatgaaaaaggaaaggaactgaagacaaagaaaaaaatcaagcttttaaaaggatgccaattttgtctagaaactgccattacagagataacaggatttaaaaacttgtctaaatttcttttaatatatttaaaaaacacactttctataactgagatgatccctacgaaaaggaaaaatgactttcagcacattgcattgtgccataatacactttcctggaatttttttgatactagtcattaagatgcataaggccaaatccaggaatatggttttgtctgataaggtgtgtcaaaatgcacaagcccagccaatgaaagagaatagctgtcacttgagagaagctggggagaaaaggcaaaggcatttttaacaacctctcacaagacactagagttttagaaaaccgatgagtgagttagttcctaggggcatcctaggttagagtacttgtctatcttaaagggattatttagttttatgttaaagagctttacctctgagaagtgaggaaggacttgtagtctctcgttggtctttctgtactgcgcaactccgcagagagtagacactcagggtctcctcacagagtaggcagaatttatattaaggtacagtccaccaaaataaatcccaaaggattttccacaagttctgaagttttgacaaacactcaagtgcctccgaaatatgattattgatagctaattttttttgagcacttactatgcaccagcattgtgttgacaactttctacacaccatactagtttgtttaattctcatgatagccctataggatatgtactcttttatgcccattgtacagatgaggaaagtcatgcaaaaagagttaaataacttgctcaaggacatattgaaaggatgtggtggagctgtagtccaactgtagttggtattattcattaacataatagtcaggaattagattgtctagctagtttatttgaaaggctgtaaaagactagttctcagtatcggtaagttgtaaggtgagtgagtgagacagggattatggaatgctacagagaatgaagagtgttaatgtggaggactagggacaaccaaggggaattataagaatactaagaactgagacacaaaagggaagaaaggggacactcaaaggagtttttaaaggtatcttcacaaatttttccaaggtccagttctaagaattaccatcagtattgaaatccagatatgccttaaaattcagaataggtacactccagcaaagctggttgcaaaagaaaattgcaccccctctttggattctcttatgccagaggggatagtggagatgttaaaataatttcagcatgtggccaaaatataggattgcttcttgttattgtggctccctggcttaggtgtgaccatcatgccaacaagtagctgaagcaagattcgggtaagctgcccctcaaactataatcttccgtagctctggtacaccttaaccaagacaccagtgagaagcaggggccaacacctagcttaatctattacactggaactattgtaatgtcctgctggatttgagctagagaattgtgatgtaatgatattaataaatgagggcttcccaatgctgctactgtgaggttttatttaagacatagcaatcaattttacttttgtattagtttcctagggttaatattaatatatattattgcttcacaggatgcaatggtataccacacacagatatatatgcacacaaacatatttgcacatgcgtacatacatatatgtacatacatgagaacacacacatctctacttctattccacagcattcagagactctaaaatagttacaacttatttccaagctggtaataagtggcataataaagaattttcacttgctgacttttgactgatataactcaacaatttaagatattaacaggtcataaaatttctttttactttgaggtaaagtttcttcactatgggatgactgatgttttaaactgattttcatttaaataagtctcataagcctgaagcagttggcagttttttaagtagaatcatagatactgagagttggaagaaaacctaaggctaggtcagtataacctcccttttgatgattccgttttctctacaacagcccaccaaaaactctcagaccatctctctctctgtccctcccctcttcttttctttcctaaattcatttattcaaacaattgaatgcctattatgtgccagttttcttcctacatgatgcagatagaaaaagtaataagataccgtcattaattttaagaaactcacagttgagtagagttgacagatatgcaagcagaaaattttctacaacgtgagcaatagaagaaaaaaataagaacagaaaaggaacagatagtatagaggagagaataattaactgcgtgtggatgtagtcggggttgggcagggtttagacattttccagaggaagaaatgccagatctgggtcttgatgggtgaggtttgctaggagaacaaatggatgataaggtagaaagagaagaaagaatagcctagtgtaaaggtagagagattaaagaacctggcatgttagaacaatcccaagtagtttgtcacagttcgttgtagttggagaaaggtagggaacaagagaagctagatcccaaagggccttgtctgcctgatcagaagaccaaacatcattctgaaggtggtggggagtcattagaagattttaagtaatctgtcactatatatcaaaagtgtgtttttgaacttaactttgaaaactttggatttctaaagttcttacttagagagacctaaaatctttctcactacaccttcaacctcatagtctccattcttttatggggttctcacagaataaatataattgcattcttctacacatgttaaatagaaacattgaacaattgtgattggattctaatgggtcttctctgggttaaacatttttagttatcttgaccattgattctcacagaattgcttgcctgaaggaagtcaggggtatttaaccactacctcttgtcttccattaattatttgagggctgtgagggcttctgaggcattggcgaaagctctgatgcaaagattagaaagtttcacagcatgcatttgaggtgggtgcagtcaacataagatgggtctgagctcacatggaactgtccactgcaggctgcagctgaaatcagaggtggatcaagggggtgtgacctggggcatgagaggcaaatgctacagtaaaggtaaaggttaagctgttgtaacaaagagatccgaaaacacagtggcctaaacaagacagaaatgtatttcttaagtaaggtctggctagtctaggatggtgggccttctctgctcaacaaggtcattcagggacacaggtttcttctatcttgttgctctgccttttcctggggcatttcctagactgtacggtcaaaactgagttgctagcatgtctgtgttctgtcttgcagaaagaggagaaaagagggagtccagtgcaaacaatttccttttaaccaagtgagacagaaattggacacatcctttatgctcttattccattgatgagaacttaatagcgtgtcgacgctggctgctagggaagctttgaaatgtttccagctgacaagctatgtgtgtagtaagaaggggagaaagaaatttggggggattcctagcaactatataacctccctcatactgaattttctgtatcgtaaaaccagtctgttttatgttttcaaattcaaattcaaatcagtcctgaagttgcaacaaaacccaacaggttcaaacacagccaaagccatgccataaccattacttactgcaagcagctaaagaattccttggtgccgggtgcagtggctcatgcctgtaatcccagcacgttgggaggctgaggcaggcggatcacttgaggtcaggagttcgagaccagcctggccaacatggtgaaacctcatctctactaaaaatacaaaaattagccaggagtgttggtgcacgcctgtagtcccaggtacttgggtggctgaggcaggagaattgcttgaacccgggaggcagaggttgcagtgagctgagatcatgccgctacactccagcctgggtgatagggtgagactctgtctcaaaaaaaaaaaaaaaattccttggttggtcttaattgagaacagtgtaggacaattctcctattacaattggtcttattaagagctgttgaaccatgcagaatgggctgagaagaaagttcctctcctcaacagaggaccacgccattttccatttggccattattcttcatgtctgtcgtcggggcttacatttcattataattcaaagaataacaggagatttaagggatttgggtaggctattttttttttaaccacatgtgcaaaatttcagagatactactttctgacaacccaagatgcaagggaaaaacaatgtgccactactgtccttgtacatcattgctaatgagggcagcttctgccacgtcagtggcatggatgctttacttcggtggaatctgtgtcccagctgtgtcatgtgccacggttatttgtatctctataacatgatgttgttcactgcatacattgagttatgtaagacatcaggagagagagaccttttgtttctctgcaagaagtatgtctctaaagccttaattggctagtatgaaatgttgacattttaccccaacttgacagccaaatcaatgttattgaaggcagcctgtaggcattcgtgacagcctaaggattaatactcttagccaattgcaaaatggttgcagcacatcagcaggccaggtgtgttggcttcctggattcgaatcaaagcaatttcaaggtgtgccctaagctattcatatattgtagacagtaaaattaaactcgatctcgactgatcacaatgggctcatttctaaagtaactttacttattccttcctcattttttatattagtgcatatactgatgaagacatggaagtttcttcatgcttgtcgaacctagacaaaatgaagttaaatttcagtagcagacatttgaatcccagataaatgagtagaatgacaaaatgactatgagtagaatattgaataaaatgactgtggcagagatagtattcaacaaacatctatgtgtttcttttgacttcctactttcctttgtagtgaggttggagccatgtggctagttttggataatagggatggagctgatgtaatatgtgacatttctgggttgagtcagcaaagacctttatgcctcctctattcctcttctgctgcattgatattggaggccacatgtttcatatggcatagctacaggatggagtagagtgttttgaactatatcatgctgtatatgaataagaagtaaactggtggcatagccaagcttattctgactaatacagaggtgttttaaattatccaaagactgggccaattctccgtattatcagtctagatgattggaaatggcattcaaaatatgtacttttgcaaatgccgggtgaagctttcaaagcttatttatttcaaagtttatttattttaaaaggtaccaccacaccctaaaggccaagatgctaactttgagggaagatcataatacacagcaaagcatgaaactgatcttcggttttacagctattattattttacttgccgtttttctactgtgtcacatgattctaaacaattctgaaattggaagtcaagctcatctagcagtgaatgatggcatctctacttgtttataaattcagacagtaagtgaagttgaagcacaaatcaaaactgcattccattgcacgtagaattagtggtatatgttggacacccaaaatgatgtatgaggaaccgattgcatctagctagaacttaaatttaaatctcctttgttcatagaggtgagctggagggaagccacatttcagccaagacattatctttcagtggtttgtcctttctcctcttgctgtaaagtagattctaagcgcaggaaagggttaatcaaatttgtggcaacaaattatttggggctgactaactttaaattagaaattcctattaaaaagttcactgtagctattaaagaaagtcattattgtaaacataactttgcttcataagaagtaataaaatacttggcagttccaggctcagtttattcatgtatccaaatcttttcaaattctcatacatttttgtaactctatttcatgtctttatatttaacttattccagacggactttgtcagaaaatcccatataagatcaagaatctgagctcatgacattaatatactcataagatgaaaatacaacttcatgatctcccttcctcctcacctgctttcatctgcacaaaaatgggaagcaatatagcatccacaacaagagaaatgatgtcattctatttattgaagaagcactgttgactgactgaataacctgcactgataatatgctaataaaataggcttggatggtgtaaaatagaattggctataaactggtccctgacagaaagaaaactggtatgtaagacttatatctattggagactttttcatttaatgagtaattcattgtaattaaaatgaaaatgaaatagcttttactagtggctcctaagagagtttatcaaggcaacagggttcctagttttagatcaaggaaattttatatctagttagttcctattcaaatagagtatcttctctttccaagaagaaaatacaacttttatttcttgtctttatcttccttgtctttttaatttcatttacttctttctttttcttttttttttttagcagacagtttgttttgggttacggatgtcactgaattatctatggactcactgagtggataatttgaattttatttttcatctgcatagaagactggaggattgtaagagcgctgcaatacgggcatttttggaatcctaattacagtttttagcttgggttgttaaaacttccaagtttctcttactctggattcagactgtcacatggatttcctgtggttttaggttttctctgcaaatgcaggcaaaattttttggatttgaaatgtccttcagtttcccaaatttaactctttaccttttgtccttagagaagatctgagagatgatgataattgaatatacttcctttcccaactctacccgaaaacataaatccattatgggggcaattcaacatctattagatgagactgtaggcaatggcacaaccctagcagggtgggcaggaatgtgtgatggtgaagtgttttgtaacacaagtgtctggctctttcagcatttaattgagctgagctctacattcttaataatatgtattgggctctgggtgactgtgcaaatctggaaatcatggctttagccagattttctcaagttcagccctgtttgcatttgggctgatcattttctgttctgggggctggcctgcgtattgtagcattagtagcttccctggcctttacccactaaatgcctatagcacttctgtccccagttggtatagcccaaaatgtctccagacattgcagaaagtcccctggggagggggataaaattattccactacagaactcctgtttttgggtgaaagaccattcagtagacaaatttgttttgtgccagagtggcacatctaacataattgacacctggaaaagatgtttgactctccctcttgtataggtaaaaatcattttcagtgataatgaagtgaaattaatatccaagagagtgagaagtttgttattattgagagtctttaatttttttatatgtaatcatgccagtaaaatataagaaaattaaacgtgaaataaattttataatacaaaacaaataaagtaatagattatttcacactgcttgcttctatcaaaacatcttatgtaccccataaacatatcacctactatgtacccacaaaattaaaaagaaaaaagtaatagatataataaattaataccttttagttatactaatgtatttttaagggaaaatcttatacctatatataataataaataattaaataatgtcacagtttaataacaaaaaacaacttgataagaagagtaaaaattagaagactaagtttcaattttaactatactattcaaattcagtaatatagttcatctattaactaaaattttcactaaccaaaccaggatactaaacctagtctgccaaaacaccaaatcaaaacacctaaggaacaatacattacagtttgtcctctgcttcattcattcattcttttaaaaatatgcaagtagtcacatagaatgatgatattgaagcaagtcaggttcaggtcctttgctgctaaaatgtcttatcattgtctactttgaatctaatatttaaatgcaggaatatgcagaaacacaagggttgcagatgtgaactctacatagggtgagttcaaacgagtctgaaatgttagcaacttcctttggaaataaatgcatgtagaaggatctgcgtgtgacagaagccaagtatataactgagagttctttaacttccatgtcaaatgtaatgtccattatgtggtaagcaatatgaataagtatcattattaaaattaataaaaatatattattaaatcttaatagtaataattgcaattgttttgaacttagactagtggttctcatccaggggcaattttgctctgcgggggacatttagtcatgtttagagacattgtcggttgtcacgactgggaaggggtgctactggcatctaatgggtagtggccatgaatactggtaagcattctgcaatgcacaggacaacacaacaaagaatgatccagtgcaaaatgtcagtggtgtcgacattgagaaactctgacttagactgaccaatgattcccacccccctccagaggagtattttatccttgacttagtttccaatgcaggtgcatggtgataataaaaagcagatttatttttagtttgttttattattgtttgtaaattttctacagacaatgcatccccttatcttctaggcttggaacagaccactctaatttcccttccctgaggaagatgccaaatgtaacaaatatcaaagcaaagagatatgtatgtggtattcatagtcctcactaaagtgttcaatgtcattaacagaactgggcttttgaagtgcctgagaaaaattggcagctctgacaattttcccaatatgctgtggttaatctgtgatgacatgagtcatgttttagagctatgggctttggctggtcccaaatggtaagaaggacttacatttaggaattaatcttgctttgagatctaggaagacagaagatgagtggcagtattggtaagaaacattcacactaattggttatatgaagtccagagagcacatataaatcaggaaatagaaagatcgaaaataaaagcagtcggttagacaaaagggggcagatatgaatttcaccaattggttttcttattgtcctgcttttgttttgttttgtattaaatgactgcaaaatattttgccccagggtgaggttaggatggtaaatcaaagccagatggatgatctatctaataaattcttaagtaatgaaacagaattcattctctgccaatggcacactcattcctgtctctgtgtctttatttattctctttccctttctttgaagacccagctcacctctccaccagagaaagaagcaaatttgatatttccctcaaagccttgtttgaattagacttttgcagtttttcttgtatgtccttgttttttaatttaattttattatttatttatttttttgaggtaggatcccactgtgttgcccaggctggagtgcacgatcttggctcactacaacctccagttcccaggttcaagtgattcttctgcctcagcctcccaagtagctggggttataggcatgcaccaccacgcccagctaattttcgtatttttagtagagatgggtttcaacatgttggccaggctggtctcgaactgctgacctcaagggatccgcctgccttggtctcccaaagtgctgggattacaggcgtgagccaccacgcccagcctgtttttaattttaatacatttccaggaatttctttatgggattacacctgcccaattctaagaacttccttccccacctcctgtgatgagtttgtgacctaggcctgaccaactgagcattgccttctcttggtcacagtgactggttcacagataataacatgacccaagcagaacaaattaggcataggtgctttcctctcactggggttgctgagagaatgggatataagcctagagtttctggtagccatcttgctaccaagaggagagaaccttccttagagccattacggaggaaagtggagctgacagatggagagaagagaaaaaggtgatgactttatttgattccctgaatgcatctgtgtctaaagtccacaactgagctttccagttacataagtaactgaagtcagtttgtgttggttttctgtcacatgtaacacaataattcatgactaacatcactttctttccaaagtcttccttaaccattttacttcatgttattctttctcaactctgaatttccataggatttataagttttagtatgtactctagcacttgattatatactgttttattgttacctactcactaaatttatctgaatccagtctttcccattatactttaatagtagaaatatgttcatggtttatgaatcagttttacattcaaaatttcatttaacttataaactcatagagaaaagataatttgtcttacatttcttttgtatttttcacagtactcagcaaagggtggtcacataatgagtacttaataaagagcaggtttagtcaaacttccattcacagctatgcttccgattcctgagcatctgaaaaacttctaattcaataagctataagtaacaaactcctaaagatagtaattttgaagtttacaaaagtaaagaaacgtaattcatcttgagccaatttacagaaatagggctaggccagttcgctagcgtgagctttgtgaagccaggaactttgtcacatttacctttgcacacactaccatctaacacagtatcaagcgaatactagatgttcaatacaagattaataaatagtaaaatgactgcattgcttataacatgctttctgcagtgacagaaatttttcatattataatttgtactgtccagtatggtagtcacatgtggctgttaggcacttgaaatgttgctagactaactgaatgcttatttttatttaactattattaatttacatttaaatagccaaattggctagtggctactctgctgtgtagtttgggtttgtaagcataaataagcagcttatactacacaatacaaggatgtcattggaaatacacaatttaaatgccatcacagatttttttgaaacaaccccaatttataatgatagtgaaagcaatagacatgtcttcttctcttatggtctagttcaagtatcacctcctttgggaaacctgtcttgactctgatccccactccacttttaccccatctagatcagaattaataaatgaattattctttccaacgatgctatgctatattctaaccagttttacttatgtctaattagtaagctagatttgttgatttttgagggcagggactatgtcttattcttctttattcattcaaaagtacttattaagttcttactatgtcagaacttacagtgtaattttctgttggttaagccactcagtctgtagtattttgttatggcagcctgtagactattacactacgactggggtatattagagtcttttggaggcataaagcagggaaactcaacaggacgttacacaacccacattgtgaaccctggagagctgctactctaaagtcatctttatgctgagacttgaagatgactaggagttaggctaatgaaggagaattgagtaaccaaggaacaagcatatctcaagtgagttacaccacgtggagattttgaggaagtaaaataatttagtatgtctgggctgggcacggtggctcatgcctgtaatcccagcactttgggaggccgaggcaggcagatcatgaagacaagagatcaagaccatcctgggcaacatggggaaaccccatctctatgaaaaatacaaaaattagctgggcatggtggcaagcctgtagtcccagctactctggaggctgaggcaagagaatcacttgaacctgggaggctgaggttgcagtgagccgagatcgcaccactgcactccagcctggcgacagagcgagactccgtctcaaaaaataaataaataaataaataaataaataaataaataaataaataaataatttagtatgtctgaagcctaagtaaaaaatggtacaggatgagaatggaaattgtgcaggacttacggaaaccaaggtaaggtattgagacttcattttggaccctccaaaatgaagccatttgaaaaaagtagagtggcataattaaagctttgctttggatagctcactttgattgcagaatggagacaaggttggaggaaagccattctgaaggcagagaaaccacggagaaggctgttgcggttgtctagatgaaagatgacagtggctcggatgagagttctcatatctctaaggcctactacagtacccagcacataacaggtgctcaacaaatatttgaggtgaaacaatttgagcggaaatctgaaggccaatatattcttcatttggatgacaaaagtaaaagcagggctacaaaaaagaaacagcatctttcaagatttacatgatgccaacagctatatcaagattacatttcagatgggtaaaatgaagaaggattttgaatctcacagtaataattttggtcacatccaaataaaaagaaaacaatttatgcaaataacattatcttagaaaatgaagagtaagattagcagggcaatgataaacaagaaaggaggatgtaatatctgaacactctatttttggtctaaagaagacttccatgttaattgaaaccaaataaaattcagatttatagttcatattttaagagttggaagtgtagcttttctcaaaactaggaatttagaggattagccttgaaaatttgttgatttccattcttcctttaaaaaataagctcagatgataatagtaagagaatttcagttgataaaaaccgtatcaggaaaaatcgaaacctgtgagacgattgaaattacctgctaaaagaaaaaaaagtttagaaaactttaagaacttgggtttttgccaaattttaaggggtagcttaggttttatcttgtccagagataaagaggttgaccaagtgccttcttaagctaccttttatcttcatttagtttgtcttcttaccctcttgagtgctccctacccttttaataggccaccttttttaaatgtccatttctgccagtcatctgtctctaccttctaaagtctctcttttgacttttaaacttttttaaaaaaccgaatgtctaaaatattgctccagccccaagctgttaccctactattggtcaaaaaattctgcaaatttcagctctcccaggaattcatcacaacctaagtttcatgtatttcactttccgacttatttttttctttctatttttctataagtccctaataccttaatatttgtatcattctgttttagattaaatatctctatggagcagaagctatataaatttgtttcaccttgggttgagcctgataaacattcttatcaaggcaacagatgagtgatgtatataatgtgtgtgggtgtgtgtatgtaattttaaaagcttgaaaatattcatctttcctgtcaggtggagatccagattcacacttctacaattaacagtcatgtgccaaagatcctcaagcataccttttaattttaggatgacttcagggaatatcaagattggcttgaactattattgtaatcattaacaaatagcatgatttaatgtaaccaacattctgagacctaaatggaaaaaaacaaacaaacaaaaaaaaccgaaacaaccctcagccattacatatctactttcagttcaaattagtatacattccattttcattacaacagagaaaagtggaaagtatggtcttctcttagccacaaatcaatatataaaccgtgatcaatggatgtgaagctcctctggaaatttgaaatatttttatgcattttggcagactctatagcaggaagcaatccattaggctttgaaaagaggaaagccaataaagataggctagatgtcaaattcttacacacctcatatttctgacatgagaactattctttctgtctgttacatccaatgatcaaaatgtggataatctagtcagaattatatctgaactatcaatcaaacaatttatctatccatcctcattttacctcttccatgcattttccacgggaacactgaaaagtatctttacctcagttttctactgcccgaaaaatggaaatgtgaatattgatccagaaatgctacaatgatcaatcatttgaaatctgaaactagaaaaagctcaaataccacagagccatttctctaacttctgtcctccttcaaaaagcagaagctgaatgtgcaactaaactttgcttgatgggtaaagcagcttcttttcatatggtagactcaactctctaaaatcttgctttccacataggaaggcttcagtatgaggctgtgattagtcacaggttgtagctgtcacactttatcatattatagccaaatgagatatcatagcataacatgagttactgacaaatttttaagtctattcctgacctatgaccaagatttatggctagcatgactgcaaatcacaaggtgacttgttcactcagaaactcgtactgaaatattattaagccatagccggtctgggaaacaaaaagccttgtaattatctactcgccaaggatcagtaacagtttgtgccaagtgagacaaacagcaaactcatggaaaagtgtttgcctttctcattaaggctatcttgtcatatatagtgtctgaaagaaaagattaagacctttgatagtttaccagccctaaaaatgctgtgcagaggctttgctgttaggcaggtgatatagatctctagaggctcggaaatactgtgttccctttggaagattttcctctttgaactcgttgtgctactaagttcatcctaagaaatcaatcttaagggaattcaaacttgttactcatgaagggaaaggtttgtcaaaatctgttactttgattgttaagttattgctctggctaagagtgattcttaaaaagagtgctggaggatagagatggatgaataaggcctggtgagttcaaatgtgatggactctttcagtggagagggagacacgtgctcctgcatagaatcctgctaggagaagaactcagaaagttaggaagaggttatgaaagatttgtgcctggagaaattgagtcatttgttccactgggaatgtggagggaaagaacagatgatattaaacctcaacattcaaaagaattatttgagttctacattatcctgtaattattacagctctacaggtctctacttgttctgcagtatcctacatttttgttgaatggtttagcacatctgcagttagaaaatgtgtaaaaaggactcaatgaatttaataatccatagttggcttgactgccttagaagaggattctaaaaatatataaattatttcagggtcacttaaactgctagcaaagactgtagctattggttagtgtaatgaaggttgaagccagcctccaaatgataccccataccccacctagaaaaaaaaatgaaaatgaaagtttgcagcttctgcaacatacatttattcataaagtgctcagagagcagaatatccagaaattgtgggcagttacactctggtgagcaaaactcagtgaaaaattattttcttgggctataggattccccctttgtactattttaacctgagtgtggatgcccccatccccaaacttctgaagtcaatgtgaacaggtgctgcacacacaggttctcaaatcagtaagtatcttttgtgctacggagtgggtaggagtgggtaggctattcaaaagaagaatgggaaattcaaccttgaaggttcatgtggaagaaacctaggcactaattagaaccactcagaaaaaaaagtgcatagaattcctgtgttgtagctttgttggtcagattgtttttcagtccaaacctcagtgtactgtagaaaatcaccacaggtacaaacccattcagcgttctacttttggaatccagaattgtcattttgaatttaacattacaatttaatctatttatgcgttccacattatatggaaatgaaagacctggtctgctcgatttgcaccgggctgcctgtatgacatgttgatgtggcagggactcagagatctgtaactcactcttcccaggactgtcttaatgaattaggaagagtcagtctttttggtcctgtttgagtttatagcgcaaatctcaatatagccataggaaaaaaagatgcatttgattgaacaaagagtgcataagggcccttaatgctttgtatgctttttagaaatataacagagttttcagaaatttcctttcttcctccacccttgaaaagcactcttttctttcttggaaataaattttatttgaataagggccataatgaggtgaatattataaaggtagcaagcttattatattggaatgactgctctactcttcctcttcaagaaaacaaagatttcaaactacctctaatgcaacctctagttagctctgctgtcactgacagaataaaaaatgaacttccattgcccaaccattgcccaaccagctttctgttgctgaagtcagatttttattgtattgggatcatttaaaattagcaggagatatttgacataaccaaatttgaccagttttttttttctcttccaaaccctgtggaaatatgtttgttaaagacggcatcactaggtttaacttgaaaatgttttatttttttatttctattatacacattgttttagtggtttaagttcaagagcaaaattgcagtgctctccctttttccttaccttgcagagatatttaatttctctaactatggtcccatttttcatttaggtctcttaaggctgcctggttttttaatgtaatggtcatcttcatatcttaataaaacaaaaattgaattatatgcactactgggcaagcatgacatgacttttgctagcatatgtaaggtgtgaaaacctgggggaaaatactattcaatttaagttccacttgagcacacggcagtgcactggaaatgagttcagccttaatggcactgaaaaaggtggaagcagggaaaggtggagatcaccgatttgaacctaattaaaaagacctgataaaaatgctagaaagccagatggtaaagtcaatttcttagtactgtgccagtccagggttggaatatgtttagcagttgacattctgcaagggtagactgataatatcagcagggaaatcaaaaggattttgctaacactattagactttacttttaaaactcatgcttctgtatctaagtggaaacaaaaaatataaattctctattttaatcaagttctaaagctctatgagagcttcaagcatttgattgctattcaatatctccaacacgaatttgaaaactaaatactaacaccgtcataatagcaaatagtggagtggaaattcagcacactaggatggttatcatcccttaagagaattgttcctctttaattttaaaagttaaacaactgattattccaaaacaacacttgaagtaaagcacttaaagaaatagtgtccacatttaggcaacttttggttactcaaaatataaacatttagaaattggaaatttcatttgatcatacaataataggtgggcctttcttgaatattttcactgccatgaccatagaaaacatctctacatggagcaaataaaaaaaaaagtagatcagaaatttttctttcttcatccagataactttccgttgtcaatgtaggattgcaatgaaggatgagtagacattctcaaatgatgcatatttatccatatatattgagtgctattaaaagttaattgaaattagaaactgagtgggctatattttgaaatattttattattttaaaagaaaacaatggaggagggtttaaaaagtatcaggggtctatccagggacaaaaagaaggagaaatagaggggaaaagggccaggataattcaagactctcattggtgccaaactttgccattagaaattaacttttggagcattgattcacagccttgatgttcttcttctgtccatttgttcctctgtgatgtaactgaataatttataggtaaccaagtcttccaccagtgtcaggaaagagcaaatagacctgcttttttccagccaacaacgaacagtaatgtttggatttatagttctccttttccaaagtgctcaggaggaagatatcttgccacccaattcatctcaaatagtggagcacctttaacaagaagtttaggtggcgtcagggacagagctaatgaggtttgttaagtctcagtttttataaagtacgatgtcagctttctgcctcacaataggatttgctcagtactacaatccctgatatctttcataaattctccccaagggagtgtgtttcatggactactgtcaagtatatatttgccactctacctatatgaaccacaaaacaaacaacctatctaagctattctacacctgaggcatacaaatggcagagtaaaatacttgtcaaaatcttcttcattactgcaggggaaaaggggagctttgctatttatgtaagcagtcaccatcgtggctaaaacattgtttcctcaccccatttgtttccccagtaggtatatttgtctctcagttgtctagctcttctttctgtgcattcctggattatattcaataacgtttgggcttttttatttgaatttgcatatttgccatcatttatttacactaaaagtatttctctaaataataatagaatcttgactgaataaatttttatacatacaaaggataaatattatgtagcaagtatcctgtttttttctaaccaattgtattgaggcacaatatgcacttgagcaactgagtttattaaaattatataattttatgagttttgacggttaaatgcacacatgaaaacactaccacaaataagatacataccatttccatcacctgcttttttccagccagcaaagaacatcaaaagtttgttcatgatgctttgtaatccagccctgcccctgtatgccccaggcaaccaatgatctactttctctccctctagattagtttgtattttttagtgtttcaaataaatgaaatcatgcagtatgcactcttcttggccagcttctttcattcaacatgattgttttctgaaatattaattttgttggatgtagcaataattcattcctttgtattgctgaatagtattctattatacaaatatatgacatttgtccatctactgacttgttgaaggacatttgggttgtttcaaattttgaggtattactaatacgaataaagcttctggctgggtgtggtggctcacacctataatctcagcattttcagaggctaaggcgggcagattgccctgagctcaggagtttgagaccagcctgggcaacatggcaaaaccccgtttctactaaaaatacaaaaaattagcccagcgtggtgtcatgtgcctgtagtcccagctacttgggaggctgaggcaggagaatcgcttggaccttggagatggaggttgcagtgagccgagatcagcctgggcggcaaagcaagactgtctcagaaaaaaaaaaaaaaaaaaaaaaaaaagcttctactaacgttttttcttgcataaatacttaaggacaaaaatgccgagttatataataggtatatatttttaaaaaactgccaaacagtttttcaaagaggttgtactattttacattcctaccagtaatgtatgaaaatgctaattgccccacatcctcatcgacacttgggtttttcatttgtttggttggttgttttagttttagccactttagtatgtttctagtggtgtatcattatggttttaatttgcatttctctgataactaatatcttgagcatctcttcctgtgcttattggccatttgtatattcttttgttaagagtctgttcaaatattctttccatttttcatttttttttttttttttgtggggaagtcttttttttattgaattgtaatagcactttatataatctggatacaagtcctttgtcagatgtaagctctgtaggatatttcctcttagtctgtggcttgtatttttactttcttaaaagtgtccgttaaagagcagaagtctttcatttcaatgattctaatctaatcattttttcttatatgtttattgatttctgtgatttgtctaaaaaattttgacaaccccaaagtcataaagatttcttccttcaccttactctaaaagttttatagctttaatctttcatatttaatctatgacccatttggggtgaatttttgcatacagaatgaggtaacaatcaacattcattttctctcgtcattgaattgcattgacattgttgttgaaaaatattttgactatggatataatatttctggactcttttttgttcccttgattgatatgtcttcattcataccacactcaagtactaaagctttatactgccttgaaatcaggtactgtactttctccagctttgtttttctttttaaaaattgctttggcaattctaaggtcacttgcatttccatatacatttaaaaatcaacttttcaatttctacttaagaaagccctgctggaatttggattaggattgtgttgaatctacagattaatttggggataattgacacgttaacagcattgaattttccaatccatgattatggctctctccattttatgtctttaatattttgcactaatgtttcataatttttagtgaggagatgtgtcatgtgttttgttagatttattcctaaatttttttatatttgaggagagggggctactgtcaaataattttttttaaaaatccatttttctatcatttgctagtatagcaaaatataactgattttttggatattaactttatatcctgtgaccttgctaaatttgttggttagctctatgagttgttttgtagattatctaggattttctcataaataattgtgtcatctggaaatacacacaatactttcctctttccagtctttatgttttttatttctttttcttgccttattgcaatagctaggagtactagcaaacacttatgggaaagtgttaaatgtctcattattaaatatgctgttattttagttctttttttttaaaaaaaatagatgcctttggtcagattaagagattttttttcctagtttcatgtcagtttgtttatatttttaatcataatagctgttcaatgttctcaaacccttttttctatctctattgaagtaatcatatgttttctcctttattctgttaatctggtgaattatattgttttatttttgaatgccaaagtaacctggcatcccagtgataaaacaaatttagccattgtgttatttaaaaaaaagatggttaaattgattcatcaatattttattaaaattttttgcagttatatttgtgaaaaatattggtcttttttttttggtaatgtctttttcagaattttatattaagtatattttggcttcataaaaccatttgggaggttctttctcctcccatatgttctgaaaactttctagtttatcctgtgtcaaatttgatagttgtatatctcaagaatttgtccatttcaagtaagttattaaacttgttaacatgaagctcttcataatttttttaaaattttaaattatatgtttaatgtatctaggacttgtcttgctaacctctttctcattcttgatattgatttgcattttctctttttcttatttagtctagctaggggttttatcaattatgttcatcttttcatagaaccagcttttggctttgctaattttctgtattacctgttttttgttgtgtttatttctgctgtcatatttccttccttctactaacttttgttttacttttctgtatattaacttcctgaggtgggaatttgggttattaatattagttctttctttttttggtataggcatcttaaactatcaatttcctcctaagcactatattttcacatgctttattttcattatcatttagttagaaacattttttaattttattattttctttgtgatttttctttggctcatgaattattcagaagtgtcttgtttaagttccaaatatctgggaatttcctagactcttattgtgttattggtttctaatttaattctattgtggccggaaaatatactctgtatgatttcaaacctttttagattcattgatgtctgttttatggtcatacatgtagtcaattttggtgactgtaccatgtgtacatgaaagaaatgttcattctgcagttattgagtgacacagtctataaatatcaattaggtcaaacttgttgatagtattgttcagatcctctatgtttaacctgacttttgtccagctattctatgaattaatgaaagagagatgctaaaatctcctactatgattttggaattgtctatttctctctttaattctgtcaattgttacttcatgaattttaaagttctgctattaagcacatgtatgtttagaatattttcctggaaaatgatccaattatcattatagaatgttactctttacctttggtaatactcttcatcttaaagtttcttttagctggtgttaatgtagctactgtgacctcatacttactgcttacatattatacttttacacttttcgcacatatctgtgtcatattaaagtatgtatgttatagagggcatatagttgggtcttgactttttagcatttctgataatatctgccttttgattggcatatatagtctattattatttaatgtaattattaatatggttgcctttatttctaatttttgtgggtacatagtagttgtatatatttatgaggtacatgagatttaaaattttttttttatttccataggtttttggggaaaaggtggtgtttgtttacatgagtaacttctttaatggtgatttgtgagattttggtgtacccacccatcacccgagcagtgtacactgtacccaattttcaatcttttatctctcacctcactcccacccttttccccaagtccccaaagtttatagtatcattcttatgcctttgcatcctcatagcttagctctcccacttatgagtgagcacatgtgatgtttggtttttcattcctgagttactttacttagaataatgatctccaattccatccaggttgctgtgaatgccattatttcattcctttttatggctgaatagtattccatggtgtgtatacatatatatatatatatatatatatatatatatatatatatatatatatatataccacaatttctttatctactcattgattgatgggcgtttgggctggttccatatttttgccattgtgaattgtgctgctataagcatgcatgtgcaagtatcttttccgtataatgacttcttttcctccgggtagatacccagtagtgggattgctggatcgaatggtagttccacttttagttccttaaggaatctccacactgttttccatagtggttgtactagtttacattcccaccagcagtgtaaaagtgttccctttttattgcatcccagcctacatgtattagttttgattttttgattatggacattcttgcaggagtaaggtggtattgcattgtggttttgatttgcatttccctgatcgttagtgatgttgagcattttttcgtatatttgttggccatttgtatatcttcttttgagaattgtctatttatgtccttagcccattttttgatgggattgtttttttcttgctaatttgagttccttgtagattccggatattagtcctttgtcagatgtatagattatgaagattttcttccactctatgggttgtctgtttactctgctgattgtttcttttgctgtgcagaagctctttagtttaattaagtcccacctgtttatcattgtttttgttgcatttgcttttgggttcttggtcatgaagtctttgcctaagccacgttctagaagggttcttccaatgttatcttctagagtttttatggtttcagatcttagatttaagtccttgatccatcttgagttgatttttgtataaggtaagagatgaagatctagcttcattctttttggcttgccaattatcccagcatcatttgttgaatagggtgtcctttccgtacttcatgtttttgtttgctttgtcgaaggtcagttggctgtaattacgtatttgggtttgtttctgagttctctattctgctccattggtctatgtgcctatttttatatctgtaccatgctgttttggtgactatggccttatagtatagttggaagtcaggtaatgtcatgcctccagatttgttctttttgcttagtctttctttggctatgcaggctcttttttggttccatatgaattttaggattgtcttttctagttctgtgaggaatgatggtggtattttgatgtgaattgcattgaatttgtagattgcttttggcagtatggtcattttcacaacattgattctatccattcattagcatgaaatgtgtttccatttgtttgtgtcatctatgatttctgtcagcagtgctttgtagttttacttgtagaggtcttacacctcctttgctagatatattcctaagtattttatttttttgccactattgtaaaaggggttgagttcttgatatgattctcagcctggttgcagagctactgatttgtgtacattaattttgtatctggaaactttgctgaattcatttatcagttctaggagcttttttggaggagtctttagggttttctaggtatactatcaaatcatcagcaaatagtgacaatttgacttcctctttactaatttccatgcctttcatttctttctcttgtctgattgttctggctaggacttctagtactgcgttgaatagaagtgttgagagtgggcattcttgtctttttccagttctcagagggaatgctttcaacttttcctcattcagtattatgttggctgtggtttgtcatagatggcttttatcacattaaggtatgtctcttctaggctgaggttgctaagagttttaatcataaagggatgctggattttgtcaaatgccctttctgcgtctattgagatgatcatgtgatttttgtttttaattctgtttatgtggtgtatcacatttattgacttgcagattttaaaccatccctacatctctggtatgaaacccactttatcatggtgtattatctttttgatatgctgttggattcaattagtttgtattttgttaaggatttttgcatctatattcattagggatattggtctacatttttctcttttttttttgttatgcccttttctgatttcggaattagggtgatgctggattcatagaatgatttagggaggattccctttttctctatcttgtggaatagtgtcagtaggattggtatcaggtcttcttggaatgtctgatagaattaagctgtgaatccctctggtcctggacatttttttggcagtttttaaaattaccatttcaatcttgctgcttgttattggtctgtccagagtttctaattcttcctggtttaagctaggagggttgtatatttccaggaatttatccatctctctaggttttccagtttatgcacttaaaggtgctcatagtggccttgaatgatattttgtatttctgtggtgttggcttaatatctcccattttcattttaattgaggttatttccattctcttggctgtcctggtatgttcctgcagtacttcttggagcaaaaagtcacaatgtgagtctgaacacgctgccctctgtctaagagttgctatttcggtacatgagatgttttgatacagacatgcaatgtgaaataagcacatcatggagaatggagtatccatgccctcaagcatttatcccttgagttacaaacaatccaattacactctttattataaatgtacaattaagttattattgactatagtcaccctattgtgctgtcaaatagtaggtcttattcattcttcctattttttggacccattaaccattcccacttcccccaagcttcccactacccttcccatcctctggtaaccatccttctactctctatatccaggcatatggttgtctttatttttttaaaaaaatatgtgggtacatagtaggtgtatatatttatggggtacatgacatgttttggtacaggcttgcaatgtgaaacaagcacatcatgaagcacatccttcccctcaagcatttatccattgagttgcaagcaacccaattacactctttaagttattttcaaatgtacagttattattgactacagtcaccctattgtgctagcaaatagtagggcttatttattctttctatatatatatttttgtacccattaaccaccaacacctccctgccagctcctcactacccttcccagactctggtaaccatccttctattctctatgcccatgagttcaattgtttttattcttagatcccacaaataagtgagaacatgcactgcttatctttctgtgccttgcttatttcacttaacaaattatctccagtttcatccatattgttgcaaatgactggatcgcattgtttttatagccaaatagtactccattgtgtacacatggtacattttctttatctattcatctgttgatggatacttaggttgcactcaaatcttagctattgtaaacggtatgcatatggctgtctttagatgtatcattttactatttggtttttgtttgctacttcttatttttatctttctgttttcctgacatggccctctgttatttgaatatacagttatatgctgtataaagacatttctgttaatgatggagcacatatatgatggtgtttccataagattataatatcatgtttttgctatcccttttctagatttagatatgtttagatacacaatatttactaccgtggaattgcctaaggtattcagtatagtaacataacaggtttgtagcctaggagcaataggctataccatgtagcctagtagtgtagtaggctataccatctagatgtttgtaggcacactccatgatgttcacacaactgtgaaattgcctagtgtcacatttctcagaatgtgtcctcatcattaagtgatgcataactatattttagaatttgatttcaatttatctattaacttttccctataatcttttaatatatacatatatttagtggttgctctagggattagagtgtgctttctgaagttgttactcttctaagtattaatagtgtaccatttacacaaaatatagtaaccttacaaccatatgggtctatattctccacctccccatcttttaaatgtaatgtttgttatgtacattataattaattacattctaaccctgcaagggattgacataatgtttgttttaaatagctgtaggcattttaaagaaattaagcgagaagaagttctttcattttcacccaaatacttaaaagtttttgattcttttcattcattcctaaaaatctgagattctctctggtgtcatttctttccagctgaagaactttctttggcatttcttatgattcaaatctgttggtgattcattctcttagttttcttttgtctgaaaacatggaatttattctatgccagttgcttcctccaaactttggcttctctctgaaatacacgtttttaatttatagttttctatttgtcataggataatttttagtagcttactcattcatactggaagtggaatttctattaatcagtttttcaaaaatatttaaagcatggggaagtgtttctgcagtaatgataagtaaaaaaaactatgacaatgaacagaatgtattccaattttataaacaataaaagcagttatgcatttataatgtataaatgcaaagaaaatttgtttaagtcttagtaaggattttttcttgctggttggattagggctaatttttattttgttctttagaacttgctataagttatatttttaagaacacatttaattttattatcataaaaataataaaattgatttaaaaagatattggaaggcaatgaatgaataattaataaatgactcaaagagccaataaatcctccagtagttcagaggaggaaaaggtttcaagaccagaaatctttcagaccagattgctttgtctattgtatttatatttttcctaagaatattgtatggttatattgtttcaaaatgtataagcattaaagatcaattagctggaatgtccaagaaaaagaacactttgattaaaagaacttttatctgatatttaagcaataaaagttttcagtttcaacacacttactggacaatatttttaaaacatatgagcccatttctctgccttatattctcaacataattgaatcttcatttgaagactaatgatctttcagggcctcagactgttcatactgcacatcagtgattcctatagaggacattggaggaagtctttagtccgtgttcactcaggatataacctggaagttggatttgtaattatctaatatgtagtttagtttacaacttgccccttttatctaaaaagttagattccaaaaaaagcctgttttaatgtttatgtaatttgaggattctggtgaaagagggggctgtttatttgaaattttggtaaacatagaaaacatagttgtcatattgtattccaaaagtagctcttttcaaaattgtttcactgaaaagttctttccatatttgaagattaaagcagaaaaaatgataccagagaaacaaagaataattctcctatgaagtttgataaaagagatttatgagattatcatctcagtctgagaatatttccctagatggaaaataaaatgttggaggaactgaaaatagaaaacaatataagttaaaaaaaatagataaatacaagttaccaattacttcattcttcttttgcctagttcccccatacagcctctgaaccagaaatagaaaccaagcgggaggctgaatgagaaacttatctctctgccacccttgctaacagaatcagcccatggatgaaacacaatgaaaaatactcatattgtagctcaaaaaagagagaggcttgccatataacttcttgaatttaaggaataaaattccttaatgagaaaaatgttagaatgcaccttctacctcacctatgtcacccagcacttatttaaactgtccccctctaaaaccactttacattctacttcctccatgtgtccctcttcaaattctatcatcggcctttgaaacgtttgctgtgaatactttccaaagttatggtgagaaatatgtactgcaggtagctcttcacctttttcagtggtaaaatattttatggggaagtggtggtgggatagggtgacaggagcaggattatacaagtaaaaagtttttccataatttttatgttcatctaggtattcttgatttctctttctctgtctctgagcaggacttggacacttacctttaagtgtactatcatctatgaatttaatgtgcatcattgtagtcactgttggggaaaaaataaatttccttaaatccaaagcaagccttttgaaatatcactcaatattttacccttatctttccaccagttcacttttccttcatcctagactctctttctgctccatgatagaggttaagacaaggagcactggcaaaaagttggggtaggattggaagagaaacagcagtcatctgcaggctccattttcacctgcagggttgctataatataagagttattaacatgccaagtcttatgttcttggtctttaaaagtgccttatagcatactccagttaactgtttattgctcccatttccaacccccctactgtggagtgtcttgctaatgctgggaaatctccggattacatattgtcattccccactgaagacagaaataagcactcagttgctttcaacattattttccactttcagtacccactgtgctatggttcagtagagtactttgtaggtggttaaattcaaatttattttttctatcaatataatgttataaaacttgccctaatgtctttaatctgtattatatgctgtatagataacagaatacttttcctaatgaaaatagctaatatatgctatatatatggagttttaaattgtgataataatgtctttttggtgactgtagtcttcactttctgatgtaaggttttgtaaaaatggctagtgattttactgattatcctcaaatggcccaataaacacagtcttaatgattctatgaatatattttcaaaataattttgctcaataaaatgtctatgtggtaggagttttaagccctgcacaatttactcaaaataaattcaattaatctttaaatgttgcagtcaataatttgctttatttattttagaaaaaacataacagctctttttcaatctaaaagagatgtaaaaaccaagactttctttaattctacacaatgcttatgcatgcttataaaattttcaaaagtcatttttcaaggaaaactgcatttcttaatctctgttaatgttttgcctctatctggttccagtagactgcccaggccctccagtgattatgttgaggaggctgtgatctagtgtattactcagatattgttgtggaagtgctggtgcctgcgcaccacaggaattagaggagaatgaagggaaattgatttgcaaatacttgaaagaaagactcagaggaatggattctggtactcttttaagggctcgtgttttttttctctgaaaggagaaacaacacaattaatatgtcaagacaacagaactagcttcttagaattaatttgaaaacaaaaagtgaaaaagaaaactgttcaaggatctttctgatctgactagaaggttctgtactctttcagagatttcagagggtgctgataaagaaccctaccttttttgactaaggctctttaagtgtgaggctgtatcagcattcagtaccactcatcattctgatatctagtcagaaatatgaagtagctgagaataactagtagctttgtagaaaaagaaagcagttctgcatcagaactatatatgtatagtgactctacgaaaagaaatgatttcaaaacctgaggcccaaaaagtcaaattttgagaggtattttgctaatctcaattcactagataattaaaacaatttacattgctttaaaaattatagaagcaatctacgttccttgtaaaacacagaatgatacaatgctacataggaaagtattaggtcaactgaaaaagtggaatatggctggtagattagggaagtgtactgttttgatgttaaatttcctgaatttgacaactgtactgtggtaatataagaaaaatattacaatatagaggagatactcactgcagtatttaaaagtgaagagcctcatgcaacttacactcaaacagtgcagaaaaaatgttatgtgtatacgtgtgtgtacagatgtctgtgtgtgcatgtgtgaatatatgtagatgtatatgaatatggcagggaaaaagccaacaataaagcaaatagggtaaaatgctaagaggtgaatctatgtaaaggatatgtgagtattttgtacattttaatttttgcaactttgaagtttgaaatcactttcaagaaaactaaaaaaaattaaaatatgaaagctccttccttctggatttttttttttgcataaacatcacacactgagatgttttaaaatataaatagaataatgctatatatttaatttcatgattttttcttttttacttatcaacatgtattgaattgtgttaatgtttcaggcacttgatttcaaagtacgtgttcatcttattgtagccaagttgccaagttttttttttttttttttgaggaccaagtagtctgtgcttctcaatgacccactgactcctatacatgtgtttaaaataactttgtcaacatttacataatagtacaaagattgggaatttgagaaatccataatatttctagggtcttactatggagaagaaagccacattatgaaattcaacttcaattgttccttgattcacttatggaaaaggtagttcattcatatggttcaaattccaaactgcacaaaaaaagcatacagtgaaaagcattctttccaccttcttctgctgatacccagcccttcttttctgaagcagccaatgctattgcttacttatgcattcatccagagatattgcatgcatttacattatgtgtgtttgcaccattatatcttcacagcatatatatatgtatgcatattaatatacagtcatgtgttgcttaataacaggaatagagtctgagaaatgcattcttacgtgattttgttgtgtgaagaccaaagagtatacttacataaacctagaaggtacagcctactacacacctaggctatatggaaaagcctgttgctcctaggttacaaacctctacagcatgtgactatactgaatactgtaggtgattgtaacacaatggtaagtatttatgtatctaaacataggaaaagtaatgtgttgtgctacaatgttacaatagctatgatgtcattaggtgatagaaatttttcggctccattataatcttaggcgatcggcatgatatgtggtctgttgttgaccaaaatgtctatatgtggtgcatgactgtatctgtgtaatattcaaattaatcacagatttattgaaccccatctatgcgccagacactattttaggtgctagtgatataacaatgaacaaaaccaaatccctgcttgtaagtagtcatcattcgatgggagtagatgtacaataaacaagaaggtgaagaaggtgaaaagtgccattaaacagaggacacagaacatgagtttaagagtgccaggccatggagcaggggtggattgggttagaattctaaataggatggataggatagtcttccttgagaaaggaacattaaagcagagacatgaaagaggatagagagatcgtcttgcagatatttggataacaccagcaaaaggaaacagctgtgtaaagtctgtaacgtgggcacatcaagcctcttatcttcttcttcttcttttttttttttgacggagtctcgctttgtcaccaggatggagtgcagtggcatgatctcggctcactgcaacctctgcctcccaggttcaagcgattctcctgcctcagcctcccgagtagctgggactacaggcacgtgccaccacgcccagctaatgttcgtatttttagtagagacagggtttcaccatcttggccaggatggtctcgatccgttgaccttgtgatctgcccgccttggcctcccaaagtgctgggattacaggcatgagccaccgcacccggccaatcctgttatcttttaggaataataaaggggtcagtctgaccagataagagagagctaaagagtaaataattccataggaggtcagagaagaaatgtggagtcagttcaaatgaatggagagccattggaggattctgagcagagaaattacattatctgacttaagttttaagaagataattctctggctgttgtgttgttgtgttgagaatatgcagtagggaggcaaaggtgagagcaagaagacagattaagtggctattgcaagaatccaggcaagtggtgttggtggtttggaccagggtggtagcagtggtcagaatatgcatacgttttgaaggcagagccaacaagtttttctgacagattgaatgtagggtaagagaaagaggagagtcaagaataaagccaatggttagatgtgagcagctgaaaagatgaggttgccatcaggaatgggcacaagttctgaggggcctgaaggttatatacaattttggggaccttcctcaggaaaatgaatataaaattacaaaaacaaaataagatgtctgataaaaatggggatatttgtttagaatgagagaataaatgacaaaattcacaagtactaaaaagcttacagacaccatgaatatcataaagtttagaaaaataacaatctttagatttttacataaaacactttattgcttatttgtttaatttctaaaagttattttattttttctctgaatattcctcattaaagggatattctttctgttcttgtgtctcacctctataatactttacctgagtatatcactgagtgttttataaagttttcttctccttgcatagtctccatttccttcaagtttctttcttcttctgtttattgtttaattttttatttttgtctctaacttctatgttgtgtactttcctcaggatatggcaatccttgcttgttgacaaggatcctttgcttggctgaactttagtcaggctcctgaaacttcttctaggcctatctgtgcacttccttgtaaaatccagttttagcaaagaaccctgctaagtcagtttagcaagaatcacccagccttgatatttgatagtcctcagtatctaaccgggttcgtcattgtccaccatctcccaggtgatgtctgatcaccttggcctgtcttcagcaaggatactattaggtcagtttagccagaatctcccttacccctgatattctgtcttagtaattttccatctactggcctccactgggctccctggctgtaaattcccatgctgtatttgaaagtgagcccaacttctctcccacactgcaaaatcccgttgtagtgatccttatacctatcatgatggtcctgaataaggtcttccttaccatactttaacaatgtaattgaaaatttttcttcaacatctgttcatgtttgaaagtgctgagagtaactcagagtctgtggctatggttggtttacttggtgtgtgagtggactgttcgctgggagctccctggtgtctctatattcaggtttttcttcttgggctcatcagtttctccagagaaaacttttccagtctcttgcctggagaatggaagactgggttgcagtgttttgcacactaagtgagggaagcatccagtttattatgcatatggttgcttaatctcattgttttaggtaaagtgtctaggtccactatatctagtcttccagttcagtgactctctattttttcctgaaagctggagaataatctttcaaacatctgcagggtagggaaaagacagttacctagctctggaatgagggaaaggatctttctagattaaactgagtttcatccaaacctcctaattttagctctcttttcctgaactctctcagttccaaaggtatcttgttttgctaatttccaggctttatgggtatactggattgtaaattgaatcatttctcagctttctccactgctggctgagttctctacctaggtcaattaactaagtctacccaagtcaactaacactaatccctctgctttctatttcaaaaaattgtgttgctgttatctcttctaatgttcttctcggtcttcaggacttttgtcgtaaacaattttttccctccatttttagtggggttttgaggggcattaaaatcagtttcctatattcaatccatcatctattccagacctccttgagatgcaacattttaatacttagttgccttactgttatattttgaccgggagtcctgattccatttccttttcagggtaaccaccacaccacctccgccaccaccacaacaaatttagctacccatctttcatcatgtgggaattaattacagaaaagagggcacattatttcatgtcaatgattcaacagtgatgaattgagaatctattgtgtgtcaggcactgtgttaggcatttaatattaaatatgctagaatattaatatcaaatattaatacacaatttaaaaacattaaatatatagaaatattaataatgtttagtacatatctgcatagggatcacagtttagcagttttaacagtgatgtagataaaaaatgctatgcataatatcagaagtaagtaataacaaagttcaaagatagcttagaggaaggtattatcaactctcttcatggaagtcttcctgaaggcattgatactgaaataggaaagcaggggtggtatcttcctatttagataaaaaatatatacttaagttagtttatacaatataaatctttcacacttctgattttggtcttagggctcttttagatgttagaatcccagacacaaaacagagataaataagtagctatttcagaccgtattaattcaagatgacagaatgtcacagtagctatgtttacaaccctaattcacagaagcaaaagagaagacacgcaatgaagtatttttttgtcttcattgggatgttgtggtgtttaatgtgctgacgtataaaaagtgctttataagatcataatattaaaacattttattatcaattcaaaaacaaaagctgatatcttagtgacataagatgatttaacaagtactgagcacctactatgtattgggaactcttcaggtgttggagatacggtgatgaacaaaacggagggtggaggacacagctcaaacaagtgtcaaaagtgtagtaaatacaggttaataaatacaggttgctatatatatatataaaatagcatataacaagttgagctaacatagttttggacttctgggaaggtcttcctgaagaagttatacttaaacggaggcagaaaaaaatgatgtgaagttagccaggtgaagttggaagtgagaggaaagaattttggacaaaggatacagcacatgtgaatgtcctaaagtggtccagagtaaggttcattcagaaacctgcgaaaaggtcagcagcatgtctgaagcctaaagtgtgaggcagagagtgacacaatacaagactgaagtgataaacaactgccagttgatacacttgtaagaatctatgttaatgaatttagattttatccgaacaataatggacattgaagaagtttatgcaggggaatggcatttttatatgtatatttttcaacaaagcattctgttgatataattagaatattataaattttcaaacccttgataaaataatgaatctgagaaatgatcatcaatggcagtgggtattatgtacacagcactgtctatgacatatttatcttaatataaatattgaatctaaattagatcaaacctctagatctaactatgaatttataggaaacgcaggaagacagaaaacaagatcaatacaccacagagatacaatcaagattgtttagagatcagtggtgaccatgaatatatagtgttagcaacatgtttagttgtaaaattttcatcattagtgcttagcggtatgagtatggtaaaaacagaaatatttgacatttaaaaacaaaaaatgtcgagggtccaaatcaagttttatttacctaagttataatttccctttatctcccaaggattttgtgagtaaaaacaaggtaatacattaaaagaactttaagatctttggaaggaatgtccttattaaatacagagtgatactaccatgattatcacataaaattaagctatttgagatgttttttatgttgttttttgtttgactcttgcattacatgccattgatttccctttgatccatctcctcatgattaacttaggtacgattttcctaaggcatgatattatcctgtcagtttaagaaacttcagagtaaatcaaaacccgatgatgcctgtgatcacaaaataacaaacatgtcaaaatagaagtgtcgttttaaaaaaatttaatagcaacttgtatcttccatcaaaatccactcaaggaatttccaaatatcaactagtttatagttaggaagtggatttcatttgaaagttaaatgtgtatttgaatgaaaatgtattctgtattttaaaagtaccttttttgtgatacagtctaatgtttatttttatgttatggcaggtacacttgcattttcaaaatttaaaacatataaaaagtggttaagaactaacatttgtatcaatagttgataaatctctaagattttttattatacagcagagtacaatggttgtgctaatgccaacagggcaccatgaaatttagtctaaaaatatcactaggctttatacaagcaacaacgtatactgctggttttagaatttcaggacatggtctgcttctaatactaagcagtcttttactatttttaatgttgtgcatttttatggtatttagtttgggaaatgttttaaaatatggacctataatgcaaaggtattacatgcagtacccttctgggtttgattctgttgtcctcaatgaactcatgcagaacctttctgtttgctgggaagatgactcaatcatcatgtcctctattgttaacactatgacctttgtaagtgtaaaataagttaaagatgggggagtatttgatttcagagaaatgagattagattggtttaggttacagacttatactagtgtctctaagacttcacttggcctttcagatcacagagaacttggaaacatgatgaatacaataattttttcataccaaaaatagattatttggtggaaatgttgcttaaaacatcaaagctctacatattttgtttttatagtcatgctcttgagaagttgctttaatagtgtttggagttactttctcagtcaagatactgaactgcattttcactacattgcactcattttatcagttgcattcatgaactgtgtgcagcagagttacatcatattggagaatgtagtcttcccttatgtaatatatttctagatgaaaaggcaaaacaagcttgaaatatcatcacagatatttgcacagaacagtgtactcttagtgaccagttgccgcccaagtattatgccaaaaccaccagtcaagcagtgaataagaaatcaacaaaacaaaacaaaatagactagtaagaaagggtaacctgaaagggagaaaccaggcattaagaacatgaagaaaaacaggctggttgtgaccaaacttgacaaattgcacactgcactttctaaattgtgtctcaaacacgatggtatggaaacatacctttactccatgagaatatttgacttcccatctggaaatcctctttactaagtcaattgttgggatgattatgtataattgagccacacacaaaatgcaaaaccatcagagattctaacaggtgtaagagcacacatgaccatactccagccaatataaaactacatgtagattgatattataagagtattcaatgatgttcttcttcaacaaacacaacatttgggcagctatggagagccaatcattacgagtctttacacaaattggtatttggaaactttgttaagataagtcagctatgctcatatagcttatttccctgcaattaaagcatttgtgacactacctacagaaaatgaattaacattcaatgcagagaaatattctgacatatctgaaatgaggtcattattagaactgctaggcccatatggtatgaagttcttaagtgaaagccttatgtggcatatttcatcacaagttgctaaacttaagaaatttgtggagaatgttgatgtgttaacacaaatgtggaccagctttgacaaaccagaccacatggctgcactctttaaaagattatcatctgttgaccgtctttattttgaacctaacactgttgttagaccctagagatttaaagatggataagacaaattccctttatgtcttcaaggagctcatgaatttgaagcatgaatgaagacaggagtagagagtcaacatatgaagagttttatgtcctaagttaatggagtttgaatttgaacatgtggtcaaaccaaaaccaccaaatgattttcattagggaagtgacatgtcagatttctgttaaagtcacatggcagggtagcaaaggggctagaggagaataagttataagaagacaaggaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaagacaaggagttcacatttcttgagtgctcactatgtgcaaggtatagtattaaatgttttatattcataatttccccttatcactacaataatacttactgacaagcattattatctccattttacagctgaggaagataaggtttaaagaggttaatttccctacagtcacaactgcagtaaaatatattgttggtatctgaatatgaactgacttcaaggtccatgcttttcttctgagctatgctattaattaggaagcactgtatcagtctagaaatgaatgatgatgaaggcctgaaccaagatagtggcagtggaatgaaaggaaagggaaaatgtgagaaatattgaagggatataattggcaagaagacttggttattgtgcagatttggaagggggagagcaaggaagagtgaggtgtcaggaacttctttcatgttttagcttgcctaaatgagtgggtggatgatgatgttattaacttaaattgaaaaagaacaaatggaaatagcaatgttggagatacaggacaaaatgggaataattgatggaatgaagtgatggaggagatgggaaacggtacaggtggatgggttacatcagttgctttttctgtaatgggaggagagaggctaagattatgtacagatataaatgagcgttggggaggaaataatattgagagattttagactcaatgacttctgcattatctctgaaaaaaggaagtgaaagcaggaggcaaagaagaggaagtgaacttgaaaagcacagcattaaaagtttgaattaaccactgtggggaatgaaagagggaacggatcaccattacctaataaaattacaaagcatttttttttcttcaccatcatatgatacccctactttattttttttctatttttgaaattaaagttatcataaatcttaaatgagataattgatatcattattcatccatagggtcagcattctttgttttgcaaagtggtgggaacaaagtacattctcatcaaaagcatacaagcttttgtttgaattttcttgtctggttctaatataaaggctacattggccttgcaaaataaattaggagggttttgcctttggtattttatggaagactttgagtaagactgaaataatctgtttcttggcatttatctggaaacttgttagagcctggtcctggtgttttcttcattggaagtttttttttaatgtttttgttttgttttactataagccaaatttatttaatagatagagggttattcaggtttttgatttctccttgagtcacttctgataaattatatttttctagaaatttactcattcatttaagttttcaaatttattataaaaaattgtgcactgtttaatatcaacatctatagttatcctcttttcactcctaatattgttgccctttctctctctcttttttccttgattaattccattagaaatttttcatttaaaaaaattttcaaagaaacaacttatatctttgttggtctttattgtacatttgttttctaatttattaaatactactcttcattttcctttgatttagttatttttttgaagttttcgatatgaataatttaattgttattttcaacctttattctttcataatataccactttaagactataacatgtcttccaaataccactttaagtgaatcctgtctgtttgaatgcttaatgttgttgtgatcatttagttgtattttctcatttccattataaagtcttcgttgacctatgagctgtttagaatttgtttgtctttagttgctgataaatgagtttttcttgttatatatcaaaatgtttgtgatttttcacttacttatggaatagtcaaagaatgttgttcatatgataacattcctttcaaatttgttgaagctatcctcacagcctagcttgtggttagttttcttaaatgtgacttgtatgcttacaaaaaatgtatagtgtacacctgttgggtacaatatcctatttatgtccattagatcaagcttgtgaattgtatgattcaaatcttccacatcccattaatttttaatatattcaaattgtcaattactgaaaggctcattttgaaagccctcataatgatgatatattattcaacttctctctgtaaatctgttattgttttatgttttgggagctatcttacttcattaaaagaagtttagaattgctttatttttctggaaaattgaacctttcttattatgtaaagaccatctttatctttggtacaaggtttttttttgttttttttgttctttttaattaaagtctgttttatctggtactaatgtatctatagccactttatttgagttacaattgcatagtataacgttttcatctattaacattaatatttctgtatactctattaaaaggtgtataaatggatatttttaagagtccatgtaacaatctttgtcttttagcttgagagtttagtccatttacatttatagtacctactgagtaattgaatgtatataaattatcttatgtattctctatttgtactattttttctatttcctttgtttctacttgtaacattttggattgattcatttaaaaaattagtggctacttagttattttaacatgtttatttcagccaagcaaattgtaaaattgtcagcattgttaccctccacctaaactacacgaagacttcagaatgcttcacttgtcattgtcacccttccaatgctacataactgcagcaatagtaaaaacacttgtattttctttcttactttattggaaatgtgtctagtgattttctgctaaaacttgtgataccctttatcaaactataaaagtatctttgtattcaaataacctaatttttatcacatactttttttgcttcattgaaatagtaatgactgcatggactgttgagaaaggctctgaggctgactctgggcctagttagaaaaagtggaatatctgactattgtggcctgccatgggcatttgggggacagaatggcagcatgtgtgccatgtcaccttggaaagcataagtgacaaaatgaaatgtaacacagagaaagcatggcttgattttggatgggtaagagagcaaagatatgtgcagagtagtaagccctttggggagaataagaggaatagccttgtgggcatcctcaacagctaggagattaacaaagatactagatcatggggaaagtaggtaatgggcaaggtaggtaattttcaaagacaaattatttgtacttgatttttttcttatggctacccttaaaaggaaaaaataagttgcacttttctcttgtggcagctcctacacccctttctctctactccttaacaaggaaatcagcaaatcacctgccacttcatattatctgttttattgctcccttccattagtgtggatgctagacacttggatgtggtgcatattagaagtaatacaggaggatattacatacacgctagtcagcagccaaaatcacaatctcatttgctagtgaatttgcaaataaccagtctttcaggtacttctctaattttcaccaaatgttgcacttttgaaagcttcattaatctagccccattaggatgggtagggtgaatgagtttatggctgtagaaggtgaagtagcagaatttgcagctcttaagaacattgctaccattcatttatgataatggtgtctaagtggcattaaaattcccctacaaaatattatttggagtaaaagagcaccaaatacatggtgaatttgataatagaatacttaaaacccaacacatgcttatttactgaaattaatggctctgaaatgacaagcatgtgatttagtcttagaatcatggtatgcatagctctagcattgcaggcaagggagaagctaaaagcaaataagtggcattctagagggaaagaaaccatatgtattcaaaggagaaatatgattgaaaaagtcattagtaccataaggaattttcagccatagttgaccttttcctgaaatgagaatgctttattttatggtgagaaatattctgtttagaaaaagcaaacattggtgtttggggaagaatatttcgggtagccactttgagtcaagatgaggtttgatgacccagaaccataacccgtgggcttggatttttgtttatgatcaatagatataacatcaaagagatgttcattgcaaatatcttatcatttttgtccttcattttcatttcattttgtccttcctttgattcaccatttgtcttcagttttgtctgccctgctgctagaaatgactgctggggaaataaagcatgaaataggtaacctcatgtgggccaagaatttttcttttccttgataggtccatttttatatatcaatttgtacaggtgcatcctgtgaccaaaggctaaaagagtagtacatactgtctagagcaatagattttatgaagggagcattttgcatacaaaccaatacaactggcagatttaatcaagttttctatgtgattaggctttgaaagctgtagccggttccgatagtaaagaaatactgtttggaaacaaattactactcttgtctttatgacatgtatcaatttacacacaagctgcataaatcactttttatatttttctataatggaaaaatactgcagggcattttaataaccaataaattatatgtttaatgaaccagaccaaaatataaatggtatgagtcaaatacccctaagagtgaggactggatattgacttgatagaaattctggtcacatagactatagactgttagatccaccacagttcaagagagtcagtgcttatacttcatctatgatcatccacgtgaaaattcttcttgggactttataacttattttcatacctcacctatctactgcttatattatgctccagagaaatcaggagtgaaaatagacagttttacctttgaccttttataagtattactccaataatttatacagtaactctattgcgcctggtgaattagagaaagcttttctcaatcacttatgtaaagcaactacacacatttgacatcacatttgaaacatgtgagagtccactgataaagggatgtagtcacagaaccaacaaaatacccttttagttttcagacacatgaacggagaccctaacaaggtgagagaaattggatgagagaaacacatgaaacttgagttgttgcaataggagtttccaagtaaatacgggatacttcattgcttcctaatcttctcatatttaggatcacatatgtccatgcattaaaacaatagagaagtaagtatatgttacctaacatgtattgatgttatttttgtttcttattaaagaacagtgaggcggtatagttttaaagaaaactgggtgggaagacaaaggacatggggtttgcaaacccctaatgaaggtgccattaactaactagctgtaaaattctggccaaatcacttctcttgagcttccattttctcatgtataaaatgagggagtcagataagatgattactaagtttttttttttcttatctatttggtattgttaaaggcctcagagtttgcatatgaaatttagtaaagttgtatcctgttgtataaaatagtcatattactgaaacattgtgtattttaatttctttctttactttgtggggagggagccaattgtattctgagcacaatggagaatactgttacttaaaggaaacctgtgatgattgtttttagtatatgtgctgtggaagccagcactctgtgatgattctttgtaaagcaaataaacctttgtaatgcaaatgtttatattctaatggttctattttcaagtttccattttaatatatcaagctcatttgctccaaagtacaactaaactttacatattaatgaaaattcacatctatatatatatatatatatatatatatttatcatttttagcctagaggaaaaattttcttcctcttctgtattcttaaatatttactgacagtgccacttatttagctatatgctctaaaaataattgtcatgtattggttaggaactcagtctctggagtaagacagcttgggttttaagtctggttctgttgcttactagctgggcagctttgaccaaaatgctccgtgttaccaagcctgtttcctcatctgtaaaaataacataacaggagtagggctcgcaagatggccgataagaacagctctggtctgcagctcccagcgagatcaatgcagaaggtgggtgatttctgcatttccaactgaggtacccggatcatctcattgggtctggttagacagtgggtgcagcccacggagagcaagccgaaggagggtggggcattgcctcacctgggaagcacaagggatcagggagctcccttccctagccaatggaagccatgagggactgtgccatgaggaatggtgcaatccagcccagatactatgcttttgccacggtcctcgcaacccacagaccaggagattccctctgctggctacaccccccagggccctgggtttgaagcacaaaactgagtgaccatttgggcagacactgaactagctgcaggagttttttttcataccccagtggtgcttggaacaccagcgagacagaaccatttactcccctggaaagggggctgaagccagggagccaagtggtctagctcagcggatcccacccctatggagtccagcaagctaggatccactggcttgaaattcttgctgccagcattgcagtctaaagatgacctgggacgcttgagcttggtggggtgaggggcgtccgccatgactgaggcttgcataggcggttttcccctcgtagtgtaaacagagccgccttgaagttcaaactgggctgagcccaccgcagcttgacaaagccactgtagcctctctagattcctcctctctgggcagggcatctcagaaagaaaggcagcagccgcagtcaggggtttatagataaaactcccctctccctgggacagagcacttgggggaaggggtggctgtgggtgcagcttccgcagacttaaatgctcctgcctgctggctctgaagagagaagcagatctcccagcacagtgctcaagctctgctaagggacactctgcctcctcaagtgggtccctgacccctgtgcttcctgactgggagacaccttccagcagggttggacagacacctcgtacaggacagcgtcggctggcatctggagggtgcccctctgtgatgaagcttccagacgaaggaacaggcagcaatctttgctgttctgcagcctctgctggtgatacccaggcaaatagggtctggagtgggcctccagcacactctagcagacctgtagcagacaggcctgttagaaggaaaactaacaaacagaaagaaattgcatcagcatcaccaaaaaggacatccacacagaaaccccatccaaaggtcaccaacatgaaagaccaaaggtagaaaaatccacggagatgaggaaaaaccagcataaaaatgctggaaattccaaaaaccagaatgcctcttttccaaaggataacaagtcctcactagtaagggaacaaaactggatggagaatgagtttaacaaactgacagaagtaggcttcagaaggtgggtaataacaaactcctctgagctaaaggagcatgttctaactcaatgcaaggaagctaagaacctagaaaaaaggttagaggaattgctaactagataaccagtttagagaacataaatgacctgatggagctgaaaaacacagcatgagaacttcatgaagcacacaaaagtatcaatagccaaatcaatcaagcggaagaaagtatatcagagctagaagatcaacttaatgaaataatgcacgaagagaagattggagaaaaaatgaatgaaaaggaatgaacaaaacctccaagaaatatgggactatgtgaaaagaccgaacctacatttcattggtatacctgaataatgacagggagaatggaacaaagttggaaaacactcttcaggatattatccaggagaacttccccaacctagcaagacaggccaacattcaaatttaggaaatacagagaacaccacaaagatactcttcaagaagagcaatcccaagatacataattgtcagattcaccaaggttgaaatgaaggaaaaaatgttaacagcagccagagagaaagcttgggttacccacaaagggaaacccatcagactaacagcagatctttctgcagaaaccctacaagccagaagggagtaggtgccaatattcaacattccttttttttttttctttttgagacggagtctcgctctgtcgcccacgctggagtgcagcggcatgatcttggcttactgcaagctccaccacccgggttcatgccactctcctgccttagcctcccgagtagctgggactacaggcgcccaccaccacgcccggctaattttttgtatttttttagtagagatcgggtttcaccatgttagccaggatggtcttgatatcctgacctcgggatccacctgccttggcctcctaaactgctgggattacaggttaacattcttaaagaaaagaattttcaacccagaatttcatatccagccacactaagcttcaaaagtgaaggagaaataaaatcctttacagacaagcaaatgctgagagactttgtcaccaccaggcctgccttacaagagctcctaaaggaagcactaaatatggaaaggaaaaaccagtgtcagccactgaaaaacatacaaaattgtaaagaccatcaacactatgaagaaactacatcaactaatgggcaaaataaccagccagcaccataatgacaggatcaaacacacataacaatattaaacttaaatgtaaatgggccaaatgccccaattaaaagacagagactggcaaattgaataaagagtcaagactcatcagtgtgcggtattcaggagacccatccgatgtgcaaagacacacatagactcaaaataaagggatggaggaatatttaccaagcaaatggaaagcaaaaaaagcaggggttgcaatcctagtctctgataaaacagactttaaaccaacaaagatcaaaaaagacaaagaagggcattacataatggtaaagggatcaatgcaacaagaagagctaactatcctaaatatatatgcacccaatacaggagaacccagattcataaagcaagtccttaggaacatataaagagacttagactcccacacaataatagtgggagactttaacaccccactgtcaatattagacagatcaacgagacagaaaattaacaaggatattcaggactggaactcagctctggaccaagcggacctaatagacatctacagacctctccactccaaatcaatagaatatacattcttctcagcaccacttcacacttattctaaaaatgaccacataattcaaagtaaaacactcctcagcaaatgcaaaagaatggaagtcataacaaacagtctctcagaccacaatgcaatcaaattagaactcaggattaagaaactcactcaaaactgcataactacgtggagactgaacaacttgtgcctgtatgactactgggtaaataatgaaattaaggcagaagtaaataagttctttaaaaccaatgagaacaaagatacaacctatcacaatctgtggaacacagctaaagaagtgtttagagggaaattaatagtactaaatgtccacaggagaaagcaagaaagatctaaaattgacagcataacatcacaattaaaagaactagagaagcaacagcaaacaaattcaaaagctagcagaagacaagaaataactaagatcagagcagaactgaaggagatacagacgcaaaaagccctgcaaaaaatcagtgaatccaggagctggttttttgaaaagatcaacgaaagtgatagaccgctagcaagactaataaagaggaaaagagagaagactcaaatagacgctataaaaaatgataaataggatatcaccaccaatctcacagaaatacaaactaccatcagagaatactataaacacctctatgcaaataaactagaaaatctagaagaaatggataaattcctggacacatacaccctcccaggattaaaccaggaagaagctaaatccctgaatagaccaataacaagttctgaaattgaggcagtaagtaatagcctaccacccaaaaaaagccccagatcagacagattcacagccaaattctaccaaaggtacaaagaagagctggtaccactccttctgaaactattccaaacaatagaaaaagagggacttctccttaactcattttatgaggccagcatcatcctgatagcaaaacctggcagagacacaacaaaaaaagaaaatgtcagaccaatatccctgatgaacatcaatgcaaaaatcatcaataaaatactggcaatccaaatccagcagtgtatcaaaaagcttatccaccacaatcaagttggcttcatcgctgggatgcaaggctagttcaacatatgcaaatcaataaacataacccatcacataaacagaaccagtgacaaaaacctcaatagatgcagaaaagaccttcaacaaaattcaacagcccttcatgctaaaaactctcaataaactaggtattgatggaacgtatctcaaaataataagagcactttatgacaatcccacagccaatatcatactgaatgggcaaaagctgaaggcattccctttgaaaactggcacaagacaaggatgccctcctcaccacttctattcaacatagtgttggaagttctggccagggcaatcaggcaagagaaagaaataaagggtattcaaataggaagagaggaactcaaattgcctctgtttgtagattacatgattgtatatttagaaaaccccattgtctcagccccaaatctccttaagctgataagcaacttcagcaaagtttcaggatacaaaatcaatgtgcaaaaatcacaagcattcttatacaccaataacagacaaacagagagccaaatcatgagtgaactcccattcacaactgcttcaaagacaataaaatacctaggaatacaacttacaagggatgtgaaggagctcttcaagaggaactacaaaccactattcaacgaaataagaaagggcacaaacaaatggaaaaacattgcatgcatggataggaagaatcaatattgtgaaaatggccatattgcccaaagtaatttatagattcaatgctatccccatcaagctaccattgaccttcttaccagaaatggaaaaaaatttcatatggaaacaaaaaagagcccatatagccaagactggaataaacgaagactggacttgactaagcaagaataagcaaaaagaacaaaactggaggcatcatgctacctgacttcaaactatactatgagtctacagtaaccaaaacagcatggtattggtacaaaaacagatatatagaccaatggaacagaacagaggcctcagaaataacaccacacatgtaaaaccatctgatctttaacaagcctgacaaaaacaagcaatggggaaagaatttcctatttaataaatggtgctgggacaactggctagccacaagcagaaaactgaaactggaccccttccttacatcttatacaaaaattaactcaagatagattaaggacttaaatgtaagacctaaaaccataaaaaccctagaagaaaacctaggcaataccattcaggacataggtatgggcaaagacttcatgactaaaataccaaaagcaatggcaacaaaagccaaaattgacaaatgggatctaatcaaactgaagagcttctgcacagcaaaagaaactatcatcagagtgaacagacaaccttcagaatgggagaaaaattttgcaatctatccatctgtcaaagggctaatatccagaatctacaaagaacttaaacagatttacaagaaaaaaacaaccctattaaaaagtgggcaaaggatatgatcagacacttctcaaaagaagacatttatgcagccaacagacgtataaacaaaagctcatcatcactggtcattagagaaatgcaaatccaaaccacaatgagataccatctcacgccagttagaatggcgatcattaaaaagccaggaaacagagttgggtccaagatggccaagtaggaacagctccagtctgcagctcccagcatgatcgacacagaagatgggtgatttctgtatttccaaatgaggtacctggttcatctcattaggactgattggacagtgggtgccgctcatggagggcgagccgaagcagggcggggcattgcctcacccaggaagcacaaggggtcagaatatttccctttcctagccaagggaagctgtgacagagtacctggaaaatcgggatgctcccgcccaaatactgtgcttttccaaaggtcttagcaagcggcagacaaagtgattctctcccatgcctagctaggcagcttccacgcccacggagccttgctcattgctagcgcagcagtctgagattgatctgcgagatggcaacctggctgggggaggggtgtctgccattgctgaggcttgagtaggtaaacaaagcagccgggaagcttgaactgggcagagcccaccacagctcaacaaggcctactgccttgagactccacctctgtgggtagggcataactgaacaaaaggcagcagacaacttctgcagacttaaacgtccctgtctgacagctctgaagagagcagtggttctcccagcacagcatttgagctctgagagtggacagactacctcctcaagtgggtccctgaaccccgtgtagcctaattgggagacatctcccagtaggggccgagagacacctcatataggtggctgcccctctggaacaaagcttccagaggaaggatcaggcagcaatatttgctgttctgcaatatttgcttttctgcagcctccgttggtgaaacccaggcaaacaaggtctggagtggaactccagcaaactccaacagacctgtaactgagggacctcattgttagaaggaaaactaacaaacagaaaggaatagcatcaacatcaacaaaaaggtcatctacgacaaaaccccatctgtaggtcatcaacgtcaaagaccaaaggtagataaaaccacaaagatggggagaaatgagagcagaaaaactgaacattctaaaaatcagagtgcctcttctcttccaaaggatcgcaggtcctcaccagcaacagaacaaagctggatggagaatgactttgacgagttgacagaagcaggcttcagaaggtcggtaataacaaacttctctgagctaaagaaggatgttcgaacccattacaaggaagctaaaaaccttgaaaaaagattagatgaatggctaactagaataaacagtgtagagaagacattaaatgacctgatggagctgaaaaccatggcacaagaacttcatgatgcatacacaagcttcaatagccaatttgatcaagtggaagaaagggtatcagtgattgaagatcaaattaatgaaataaagagagaaaacaaggttagagaaaaaagagtaaaaagaaacgaacaaagcctccaagaaatatgggactatgtgaaaagaccaaatttatgtctgattggtgtacctgaaagtgatggggagaatggaaccaagttggaaagcactcttcaggatattatccaggagaacttccccaacctagcaagacaggccaacattcaaattcaggaaatacagagaacaccacaaagatactcctcgagaagagcaaccccaagacacataattgtcagattcaccaaggttgaaatgaaagaaaaagtgttaagggcagccagagagaaaggctgagttacccacaaagggaagtccatcagactaacagcggatctttctgcagaaaccccacaagccagaagagagtgggggccaatattcaacatttttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaagaaacaactggtaccagccactctaaaaacaggccaaattgtaaagaccatcgatgctatgaggaaactgcatcaattaacgggcaaaataataagcgaacatcataatgacaagaacaaattcacacataacaatattaactttaaatgtaaatgggctaaatgccccagttaaaagacacatactggcaaattggataaagagtcaagacccatcagtgagctgtattcaggagacccatctcatgtgcaaagacgcacataggctcaaaataaagggatggaggaagatctaccaagcaaatggaaagcaaaaaaaaaaaaagcaggagttgcaatcctagtctctgataaaacagactttaaaccaacaaaggtcaaaagagacaaagaaggtcattacataatggtaaagggatcaattcaacaagcagagctaactactctaaatatatatgcagccaacacaggagcacacagattcataaagcacatccttagagacctacaaagagacttagactcccacacaataggaatgggagtctttaacaccccactgtcaatatgagacagatcaatgagagagaaggttaacaaggatatccaggacctgaactcagctctgcaacaagtggacctaatagatatctacagaactctccaccccaagtcaacagaatatgcattcttctcagcaccacattgcacttattctaaaattgaccacataattggaagtaaagcactgctcagcaaatgtaaaagaacagaaatcacaacagtctctcagaccacagtgcaatcaaactagaactcaggattaagaaactcactcaaaattgctcaactacatggaaactgaacaacttgctcctgaatgactactgggtaaataaagaaatcaagggagaaataaagatgttgtttgaaaccaatgagaagaaagatacaacatatcagaatctctgggacacatttaaagcagtgtgtagagggaaatttatagcactaaatgcccacaagagaaagcaggaaagatctaaaatcgacaccctaacatcacaattaaaagaactagaaaagcaagagcaaacacattcaaaagctagcagaagacaggaaataactaagatcagagcagaactgaaggagatagagacacaaaaaacccttcaaaaatcaatgaatccaggagctggttttttgaaaagatcaatgaaattgatagactgctagcaagactgatgaagaagaaaagagagaatactgaaatagacacaataaaaaatgataaaggggatatcaccacgaatcccacagaaatacaaattaccatcagagaatactataaacacctctacacaaataaactagaaaatctagaagaaatggataaattcctggacacatacaccctcccaagactaaaccaggaagaagttgaatctctgaatagaccaataacaggctctgaaactgagacaataattaataacctaccaacaaaaaaacgtccaggaccagatggattcacagctgaattctaccagaggtagaaagaggagcgggcaccatttcttctgaaactcttccaatcaatagaaaaagaggcaatcctccctaactcattttatgaggccaacatcctcctgataccaaagcccagagagacagaacaacaaaagagaaatttagaccaatatccctgatgaacacagatgggaaaatcctcaataaaatgctggcaaaccgaatccagcagctcatcaaaaagcttatccaccacgatcaagtcagctgaatccgtggcatgcaaggcaggttcaacatatgcaaatcaataaacataatccatcacataaacagaaccgatgacaaaaaccacatgattttctcaatagatgcagaaaaggcctttgacaaaattcaacagcccttcatgttaaaaactctcaataagctaagtattgatggaacatatctcaaaataataagagctctttatgacaatcccacagccaatatcatactgaatgggcaaaaactggaagcattccctttgaaaactggcacaagacaagggtgccctctctcaccactcctgtttaacatagtgttggaagttctggccagggcaatcaggaaagagaaagaaataaagggtattcaattaggaaaagaggaagtcaaattgtccctgtttgcagatgacatgattgtatatttagaaaaccccattgtctcagccccaaatctccttaagctgataagcaagttcagcagagtttcaggatacaaaatcaatgtgcaaaaaatcacaagcattcctatcgaccattaacagacaaacagagagccaaatcatgagtgaactcccattcacaattgcttcaaagagaataaaatacctaggaatccaacttacaagagatgtgaaggagctcttcaaggggaactacaaaccactgctcaacgatataaaagaggacacaaacaaattgaagaatattccatgctcatggataggaagaatcaatatcatgaaaatgtccatactgccaaaagtaatttatagattcaatgccaaccccatcaagctaccaatgactttcttcacagaattgaaaaaaactactttaaagttcatatgaaaccaaaaaagagctcgcaatgccaagataatcctaaccagaaggaacaaagctggaggcatcatgctacctgacttcaaactatactacaaggctacagtaaccaaaacagcatggtactggttccaaaacagatatatagcccaaaagaacagaagagaggcctcagaaataacaccacacatctacaaccatctgatctttaacaaacctgacaaaaagaagaaatggggaaaggattccccatttaataaatggtgccgggaaaactggctagccatatgtagaaagccgaaactggatcccttccttacacttcatacaaaaattaactcgaggtggattaaagacttaaatgttagacctaaaaccataaaaaccctagaagaaaacctaggcaataccattcaggacataagcgtgggcaaggacttcatgactaaaacaccaaaagcaatggcaacaaaagccaaaattgacaaatgggatctaattaaactaaagagcttctacatggcaaaagaaactaccatcggagtgaacaggcaacctacagaatgggagaaaattttcgcaatctacccatctgacaaagggctaatatccagaatctacaaagaactcaaacaaatttacaagaaaaaaaaaaacccatcaaaaagtgggcaaaggatatgaacagacacttctcaaaaggcgacatctatgcagccaacagacacatgaaaaaatgctcatcatcactggtcatcagagaaatgcaaatcaaaaccacaatgagataccatctcacgccagttagaatggcgatcattaaaaagtcaggaaacaacagatgctggagaggatgtggagaaataggaaggcttttacactgttggtgggggtgtaaattagttcaaccattgtggaagacagtgtggtgattcctcaaggatctagaagtagaattaccatttgacccagcaatcccattactgggtatatacccaaaggattataaatcattctactataaagactcatgcacacatatgtttattgcagcactattcacaatagcaaagacttggaaccaatccaaatgtccatcaatgatagattgaattaagaaaatgtggcacatatacaccatggaatactatgcagccataaaaatggatgagttcatgtcctttgcagggacatggatgaagctggaaaccatcattcccagcaaactatcacaaggacagaaaaccaaacaccacatcttctcactcataggtgggaattgaacaatgagatcacttggacacagggtggggaatatcacagactggggcatgtcatggggtcgggggctgggagagggatagcatttggagaaatacctagtgtaaatgatgagttaatgggtgcagcaaaccagcatggcacatgcatacccatgtatcaaacctgcacgttgtgcacatgtaccctagaacttaaagtataataataaaacacacacacacacacacagacacacgaacacaaaaatttcagtacacaataaatattgccagcactgaacatttttaacggaaaaaaataaataaaatcaaacaataaaaaaaatgtcaggaaacaacagatgctggagaggatgtggagaaataagaaggcttttacactgttggtggggatgtaaattagttcaaccattgtggaagacagtgtggtgattcctcaaggatctagaactagaaataccattcaacccagaaatcccattactgggtatatacacaaaggattataaatcattcttctataaagacacatgcacacgtatgtttattgcagcactgttcacaatgataaagacttggaaccaacccaaatgcccatcaatgatagactggataaagaaaatgtggcacatatacatcatggaatactatgcagccataaaaaaggatgagttcatgtcctttgcagggacatggatgaagctggaaaccatcattctcagcaaactaacacaggaacagaaaaccaaatactgcatgttctcactcataaatgggagttgaacaatgagaacacatggacacagggaggggaacatcacacaccagggcccgtcaggaggtggggggttagggagggatagcattaggagaaatatctaatgtagatgacgggttgatgggtgcagcaaaccaccacggcccgtgtatacccatgtaacaaacctgcaccttatgcacgtgtatcccagaacttaaagtataattaaaaaaaaataacaacagcaattaccttgtagtgtttgtgtaatgattaaataaaagatatagagtacttcacttagtgtctggcacataatatacacttactaggttttagctattagcattattctcaaacgcttcttgtattgtgagttttcattttatataaacaatatacgtagcacactttacctggattataaacttcgtgaagtcagagactataatgacgcttctttgtatagtatccactacacggtctagtagaatgtcttgaactgagtaggtacccaatatatatttatttttactagttgtttctgatttacaccagagaggtttttatcctgttttaaaatagaccacaactaagaacaggaatgtaagatatgagtggtgatattaggatttttaaagctgcaaggaaaagacacacccagattaccttcaaggatggaggtttattgcaagggtacatgagcaaatgaggtagtgaggtcactcatgatttgcgtagtcactctggttactgatgtttccaagacttggatatctgcctgggtttgaatcctggctctgccacttacaagctgtgtgaccttgggcaagatgttaaagcactttgtgtcttagtttctctatctctaaattgtagatgaaaatagtatacatctcacagggatgaatgaggattaaacaagatggttcatgtaaaatgtttattgcaatgtccgacccatggcaggttctcaagttatggtagctactttgtagtagtagtagtagtggtggtagtaatagtagtagtcattattgtagctattattgcacatgtcataaaaaaatcagaatacacctcagtgtcattcaggataatgcccttaagtcatgtgatttgccttttcttttttatctagcatttgcatttccccaaatagaggatttgattgagttcattcgccaaccttcaacatgcacagccaaagccaactcataattaggtgtgctccattctgtccaacctctatcatgattgtatttaggaaatccattaattccaggttcagtctattggctaggctagtaggggtttttttccccatttttttgaggtataattgatacacaaataactgcatatatttaatgtgtacaatttgaagaatttggacatttgcatacacctgtgacatcatcatcacaatgcaggtaacacacattggatcagcaatgataaaaagacaaacagacaagcagaaattggatcattttcctcaatagggatgtgtttctaagttgatcgctttgccttcatgtactcttctttgagcgcatatagtctagtgaccttcctaaataatcaaatctggaaaaagacatttccttttcagtacatgttcatttttttattctaggacttcccactctaacttgcttgatcaagactccttgatctctttcttttcttgtcacccccagtgtgagtttccttaaagttcctgagaatctttttaagtctgccagacacagtattgaatcaaataaatattacctaattaagtcacacacaacttaagaacctctgtgataggatattagcagtctggattcccagaaatcatgctgcttcattatacacaaactgcaatttttatctatctgtgtaaggtccagatagaatgagttagttattcagattgaatgaaaaatcaccaaggattttcattgtaaagtccttcactctttatcaagggagacaggcctgtggataggtcagaaacaatcaaggaagattttgtggcccaaagattcctcaaagcccagtggctatttactcctgccttgaataccatggctatattttaaatattcactctttcactattgaagcagcttagttcatgtctacatctttcaaatttttcaaaattaacttagagttaaccttgatggctttttgacagctcttcttctataaccatttttaaaatagctttggtcaccgttgaggcaaacctctttgtttaaaactcacatttaagacatgaaataggccggccatgatggctcacatctgtaatcccagcactttggaaggctgaaacaggtagattgcttgagctcaggagtttgagaccagccttggcaacatggtgaaacccagtctcttccaaaaatacaaaaattaggcaggtgtggtggtgcatgcctgtggtcccacctatttgggaggctgaggctggaggatctctggagcccaggaaagttgaggctgcagtgagccatgatcatgccactgtactccagtctaggtgacagagtaagactctgtctcaaaaaatgtatatatatggcatgaaatactagcagatagagggcataggcatgctagtgaaaaacaaggcatgggatcagataacgtccaacagattttatagctaaggacctagaggggttagagttgcccgttctgctttccagagtccttttgggttttatagcagccatagagctatcattcaggccaacaggactcttgcgatcaacagtgtcaaaacatcttataaatctcaaataatcagcatcctctaaagaggactctgggccagagtgaataatgttttgaagacagccatgataatccctgcttcacacctgaaacaaggctgaaataacagaggagagatagcgaaattacacagaatagctttgcttttgaggttccaggaaaccattcagcatctcttggtaggagattcaaacttatcactgtccataatcttgtggtgtttcttaaaagggtagcgacctatggctcagctgatgctattttacaaacaaatcaaaagcactaaactcacccaattgctgctcagtggctgctcttaactaagagctggagagctagggttcattcgacagggctttgacttaattaacatccttccctgacaaggccctttctccattctcctaaagcatcttatatcacagtgagaccatcagtcaacatatacagttacacttgttccttttctgtttctcaggatatctctagtattccagatttaaccctcagaagctttactttctcagatgaacaaaaattctccaatgtcaagataaaataatttgaagcatttagacttgcacttcccatttcaggttatgatactgtatttttcaatattgattgtgaagaaatactcagtacattctgtcttttatcaaacactggtgttgcttatacccagaaaagaaaagttggtcctaaccatttttttaaaaaatatatccatttttttctatatatggctgaattactctattagtacttttaagagacatgacctcagagctctcctctgactcttttctattatattcaatgtccttaaatgacagtcattgtctggggtgaataggtacatcttgaccttacaacaaaggctaaaaggcagaattaagaaatttattacctaaaattctcctagagttttactctgtttctctgggtggattataatctgctaggccttcaagatactcatgatgaccagtggaaatttgctgacattatgtcagcaactgtcaatcagtggtccttggtggacttacaggcagacagatgaacaaagtgaactttcaaagcccagagagagcagagcccagcacaactcgcagttcactgagacagctatggaggaaaattacaaaggactgtggtgttctacttgtgaatcaagctatactcaaataagattggtacctcaaggtatttgtttgattgacttgcagggagtttgctgtatttgtctttcttgtcagaggccatcatcatttatattcaccatgaaaaaggagaaagtaagcttaaagaataccttttgatattccagattgccaaaaagcagaaatagactccagatagaacaaaggacatattatacgaaggactgcaacaattacagtactgtgagaagcaggaggggaaacaaaactattgttgagaaaataaagagaaaagggaaagaaattactctcttggcactgcacagtgggacagtgggtacaagtttcttctcagagagggtaaaggcccttcagtatgtatgctacattaataaagaaaagctgaaacagtgaagaagatgaagataatgaaaaccaaggttgtggaattgaaaagttaaacatcttgagagagaagatattctgaaaagggattctggaaagaagtcttataccactgaaatttttcaataggcagcaggattgtcccacaaaattgaatcgaggtcttccagaaagaataatggaataattaggagaatccaaaaacatttgggaatgcagagaaaagagtcgctaaccaaaagagaaagaggcaaggggtttggggtggtcttgagaaatgtggaagttgctggatataggcctgtcatgcatagatagctcttcagtatgtatgcaacattaatgaagaatttattacgagaagctccaaatcaaaaagaaattggattttttggagaaaatcacactggcatgattttcttagggaaaaagtatagtactgtggaaacagcatagatttcagctccagcctttgacagattgaggatcaaatcccggcacagctttcagtaaatgcacaaattacctcctctcagctccagtttatatgtctactaaatgaggaaaataatagctatgtttcaggtttgctgtgagaagtacatgatatacttctaataatgggctcataattgggatttaataaacagcatatatttttggttattatattttttctgggtaaaaacaagatatagtttatgagaaatgactttgtgcttaatccccatcagagggaggtgatctggtaactatttacaaataaaataaaataaaattaaaaaggcaaatacaacacagaagcccacgtagtttttgaaagtaatacataatgtttactctgactgactacatataattctgtaggctgaatgatttggagtaaattgtagcattatattgattcttcctaggatgaagttaacacttggggtgctgtttactatgtagagtataaaaattgtcatgaaaaagtattcatagccatgtgctttgttttgtttccctctggaaaactttatcatgaggataaattaatagtgccactttcttttcattaagcctttgtcataagcaagcaacagcagaattttaatgcctcacctattcttcaaattcttattattctttttgaaaaatattctctgtttacattgttttacatgttacactatttctcataatgctcaaaccatacaattataaacattcgatgtgaggtcacaaaagaaagggaaaccaaatgcagctgatgattattccattgttttgatcatgtcaaaatagtcccatcagaacacactctcattatgtcaccacactgttgtaattttgagttttcctgtagttttagaaagaatttatatatttattttatttttattttaatttctttcttgagacagagtctcgctccatcacccagactggagtgcagtggtgagatcttggatcttggctcactgcaacctctgcctcctgggttcaagtaattctcatgcctcagcctcttgagtagctggtattacaggtgcatgccagtgcactaggctaattttggcatttttagtagagatggagttttaccatgttggccaggctggtctcaaactcctggcctcaagtgatctgcctgcctcagcctcccaaaatgctgagattacatgcatgagctaccaccaggcctggccaagtatttatatatctcaacaatcatcataactgcataatttagcacacattaatatcctataataaaacacatgtttacttctacaatgtttcaggggcatctacatttgtttacagttacagatgtttcttataagataacattctgtttctccataatgtgaacaatttgcatgaaaaaagtactcccaaagttacatttgtcccatttgctttacaacattatgacaggaacctttgagggatacttctgtttcatattcctatactgccagtggttgcaaaatttccaagagcaggagctgtaggtcacaatggaaaatggaaacagtagattgggatttgacttactaactgtatggctttagggcagtctcttaatacctagggttttttgttacttggtcacctgctttctttaaagaagggacttatagatggattctcaaagtctcctctaacttacaattttatattttgtgataaaaagagttgagtttgtcagaggacaaaattcttttcttgattttgtctgaaagggaggaatcttcaggtctggacaagatgcttcttttcttacctaattttctttctttctttctttctttttttttccctaattttctttaatgaacatttgtctttcttggctgaaagaagataaaccagatgggaaaaggttccatttaatattagtagtgtattcatatgatcttgcagtatccacagtacgttttcacctgttcaggaggtgtgggcaatcacttttgtggtttggggtttctcaatgatactaaggtatgaagtataaaaacaatcttaaaaccacatctataattctgtggttgtggacactacttacaacattccatgcttgttaatctaaatatagcttaaagaaaagtctaccagcgataaagatttaaccactttttttcttagtaaaagtaagttcatcgaaaaatacattttgattttaaaagttacaatggcaataattgtgtgttataacaagcgaaacaacacaaagttgcattaaaaaaaagcccttaagtatctctttccactcctactatcaatctctctctgcaataaccaatgttaaccaaccccagggtgttttcttcaccacctttcactgggctcatgcaagtacatccaagtaagtttttttccaatttatacaaaatatcaaaactcaaggttactaatgaaatatgactctttccaatgactaccaacatttctttgattggcaaagtcctttgtacatacagcctatcctcccctgagctcaatctcagctcagtctcctttgccatttgtatggttcccattccttaaaaatgaaaagaagccattcatttccaaagaaagcattctcttgggggcaatgaataaacacagcacttcctttctagtagctataaactttactgtagatataaaatttacttaccacactataatatttgaatgattttggtacccaaacatttagccctattgtgggatgttcagatcagatttaaaattttcttttgaagtgtcttaacaaagaggaaataaaaacaaattcaggtggaaaaaaagtagctaacagcaatctcacttgtagaatggtagctggtcttattctcagagtgcatcaactttgatctcatttgtaactctaagtgtcagttagagcaacaaaatggagattgtaagagggttagatattccatattaggaactgttttgaaaagatatccatccattacattattcaaagatagagattgtctggtagctgtggtatgtacagccctgacccaatttctcagtaaaaaataattagcatatcaatgttccttaaggaaataatggttttcatgctagaggagcaggttcattctctgcacacaatgttgatcctgaaatgtcactctccagatgcagtttataactgaatgaagagctagctcagcaagaagtcaagacttctgtataatataatgatgagacattttttaacctaatgggactctgcatgacaaaaatttttaagatgataatagtactggataaattattacctgctagttcaacccccagaaggaaagaatccctttatataatgttgccataagagttacccgaagatttataggttttgcaggaagagtttaatatttatctataagagtctgaattagaggcagagaatatggaataaagcaggagattacttcagtgactgcaaatccccagacttctggaagcctaaaggataaaagtgtcattactttctgagaagaccccgagatgagtacagttttaattggcagaattttaaaggaaattaaaagtgtgtattatgaaccttacaacaacctcagtgaagactgtcttcagaaactgagcacaatgattcacagaaattgggaataattatgccaacagtctgccagtggcaccttcctgcagatttatatctaaaaagagaagcatttgatagtctttttaataatatcatcttatccaaaatacacatacaggaagagtttgtgtagcttggatgaagtcataggttagacaggtagatctctaaatcaacagaaaagcagcacctctcctgaggaagtctccagagacattttgcatgctaagcctgttaagaaggaggattatcattagtgtcaatagacacaggaaacttgggcaacagatgtgggcaatccataagaactttggcttccaacaactgtcttagttatgcccagctgtgcatctgccaatgctaatccatcataacacaacctgctatttactttccttgcggtgatagggatttaagaggatgatgaaagagaaccaagacctatgaagtaatttagaactttcttgaatttaaactctcccttttacttcctatcatatggcatattgaaaagataacataacacctaattgcagctagagtaattgctgccaaaattaataaagggaaacacaatagtttactgagtttcttgtttatagtattttataataccatacagaattatttgatagaagttagacaagaatataatttgttaggtagttatccatctttaatgttccggctctttcacataaggatgatctatcaggtattcttcaaaagcataaacagctaaatataaataaaacatcataagcagtactctaaaggaagtaagatttatgataatcctgctcaactgaagagagagagaaaaatgaagagagagagataaataaagagagagagagagagagagaaaccctgttcctctaccaacccataccattatcatgtgcatatgtgtgtttaaagtcagtgagaataaggttaacagctctttcagatgcaagacatgccattcccagtaagacattttttctattaggtatccccctccccactgtactgtttatagttagtagtgtgtgattccttgctaaaatagaaaagaagctcagagctctatgctaataaggtaaggcttctaggttctgtcccatgcctatagagtagttcatatcttgaagtctacatgacactttgacagttgctttgatgtagccattaccaaataatgtgaaaaatagaaatccttacctctttcctgaaccttgccctattcctgagttttatcccaacccagatcttcattgtgagagatgttggtaaggaacagggtggagctgtgacatctcagtcattggggcatatgggctcttgccatattcaagttggaccaagagcattccttatgtttgcaaaagactctgcatttttctctatttcttttatatgcaattcaacattaaaaaaaaaaaccctacaattgttttaagcgattcacttgaaaccagatggatggcctcatggatgtgaagatatttaccgtgtcttcaggagaaagaaaaagagggccaggagtacatctgagctataaaatcatctgtagatgctaacttcttaagcaaatgaaaaggtttttgaggacagggacaataatcattcattaaggcccattcctacagaaggtgttcagtatttgtttaggttaaaccctatgaaattgccatctttgtaggtgaaaaatgacttcatgttggcaatttcatatgattcaatctaagagttaagatcctatgccatacctcactttagcatactggaaaaaacatgagagctttgagcagacaggcctagattgaaatcccagctctaccaactatgtgaccttgggaaagtatcagtctatctgagccttagtttctttatctgtaaactagagagactaataccaatcacataagatgactgtgccaattaaattgaaaaacatgcaaaaatgacctgcaatagagacagaaagtagaccagtggctgcctagggcctggcagtttggggaaaaatgtggaatgattgctaatggatgctttttagggtgataaaatttttataaaattagagtgtggtaatagttgtacaactctgtgaatatactgaaaatcaccgcataatacactttaaatgagtgaattgtatggtatggcagttatatctcaataaagttgtttttaaaaagtcataataagggagacacatagagaaagtcagagaaagagctcaaagctactaagaaaaaacatgcttagacttggcctttcacaaggctcatttgtaggcttgaaaacaaacaaacaaacaaacaaacaaacctctgagtacttcttgaattaatccagtttagcatgaaacagtcatcacaaagcatgatttctaattggctatttctggtactagccacaggggaagaggttgtttctttctattctacatctggcaaagatctagttttgatataacaaatgtcatgaagttaagatttattttaagatttacttcagagttgaaaaaaagctacaattgacagactgtttggctgtttcacatctcaggcctcccagtgtttggtgcatagtcatgtgaataagaaagctgtcttccccagcactttgtcattgcagttgcacaaactcaacatgagtctggttttgaacagcagcacagcttggacaatgttcaatcaccacacagagtctgggcaatgtaaaaagcagaccagggaggcctaaaaagagggcataatagttacttgcccagatgatcaaatcacattttcctcttctaactgttagacatttacagggatacaattcggagatgcctttgggtcctatttaatccctatatagaaactaagcatttgctaataaagggccagattcttatgcagggaattttatacataggactttactgggcacaaatctggacagaaaaggattccagttttgaatactgccctatgatacatttgtaaatagtccatcctattctggatgatttttttttttttacccaaaagtgttattcagtgaattgcttcccctctccatctgtgcaatttctgcataagataagaacagttatcaagaattacagaccagtgatttcaccttaatttgcacatcaccctctgaagatgcaatgtcttgctgtttaaatgtgtgtttgtttctttttaatcaacagcatctataagtcatacccagaattaaataacaacaataaggtgctagaatgcagccaggccactagcattgaaccaactcttatcccaacactagcaggatatctgaggtagataagagcagggaaggtgagctcctgtaaaagttgtgaaatagatgattcctttctgtcgtacttttccagcccttttgtttccaggtacccagtgacctactgctgtcttctaggtactgagatcctaacactgctaaataccatgagaatcaggcagaccaatgctctggatctttttcttctttggtcttttcttcattacttactcatcctatatattccactcttcagtcatattctattttatggttagtctgataaaataattcaaggtgaggagttaatgctttgaaaaaattctatgttttgcccctttgaggaagcatttgcattttaacagtgggctttaatgtcttgaattacagttaatccagtcaggaagagattttagtccaggattttttttatgctccttaaataatatcatatagatttaggctatctttttggtttatatataagaacaagatttatatatacatacatatatatatacacacacatatatatatgaacaagaatgatatgtgtgtatatatatatatatatatacacatatatatatacacacacatatatatatgaacaagaatgatatgtatatatatatatatatatatatatatatatatagcaacatgatgaaatagattccacatgaagaggagactgcaatcaacaaggatatacgatatgcttcaaggatccagtaaaagtaaattttaagtaatgaagcttgcctgtgaaccacaggtaaatactagcagcagacagatgaaccaacagtagaaaaagcagatggggtaggatttaaaaaaatattttaggaaacacaaaggaatctgtacatttaagtcggctctatgaaaaccagttatagccacaaaccaatggctgttattctggaagtgggaagaagaacttcaagtgatttgtcttttgagtaacagccattttgagtatagccaaacaatatctgcaaggcttgtaatttacacatgtacacaaatgtataaaaggacacatatctttacactacaaaacttcagatgtataaattatacatttaggactttaaacaatttgccctcttgtcattctgtaagttatttatgataaaagagcactttttctcaataaaatcataaaaacaactgagacgagggtttattaaattcaagatttacttatttctatacaaattaatgcaaaaatataagtgactgctggcaatattaaacatccatggaataaataatactagttgttaaattacttacaaagaacctcttctgcacacttttcagagaagcattttgagtaaaatttgaaatatcttgttactgtccagtagactagcataatctcagacactgctctctctttatgctattttcttctgggttttaatcacttttctaattcttccttgacaaaggtgataaggtataatttagctatgagtgtctattctacatacagaattcacacattatgatcaaaaccaatccatcttatcttttgttttcaaagtagaaatgagggtagaaggttcacaaatgcatggaaaatccagtatatcttaattaatgtgaatgtttcctccaaatcaaatactgcagagaaaatcctcaattgtcaacattgaacaatagggaaactggagaatggattaccttttcttcaatagaatggatcatgctcttcacaaataaaaatagtacagaatttaggtccagaattcactgaaattaaataatctcaattttaactgcaacatacactcattaagaactgattataagcaaggatctatgctgggagaatatggaaattcaaagataaaaaagctaaactctgttgtcaaagactttacaatctactgggaagaaacatacataaattagtaggtgatagaataaaagttatatgatgttcctacctattccttatttcaaaagcatatatttcttttacttgaatgtcttctcaagagaaacattaaatactcttaatttgagaatattattggaagaaaaatcttgcatatgactttagttttgtaggatttgcctcctggtattctgtaccaacatttctttttttctttttttttgagacggagtttcacccttgtttcccaggctggagtgcagtggcgtgatctcggttcaccgcaacctctgcctcccaggttcaagtgattctcctgcctcagcctccccagtagctgggattacaggcatgtgccaccatgcccggctaattttctatttttagtagagacggagtttctccatgttgatcaggctcgtctcaaactcccgacctcaggtgatcctcccacctcggcctcccaaagtgctggtattacagtcatgagccaccgtgctcggcctctgtaccaacatttctatctgcttttcccatgaactaggttctcctcaactctgtgtcaatccattctactccaactgttcactaaggtttagagaaattcataatgctgagaactatcactactatcacatgttatatatgtttttgtgggagaaagtttgtgtcagagtatagatgcccttcaaatttcctttcatttgaaaatgtcggggcagtgacagatatagaatggcaggagtgtaacatgggggtaaattctatgacaagagtcaaataaagccacaggcaattgctctggtgtcgaaggccaagagaacagtattaaaatcaacatggtcaaagaaaaaagaagtcatacttctcttaaaaagaagtatgcattttttcttcctggctaaacaataaaattccataagcataagctacactgcctgtctgttcctctgaccaatttgcagagtatgctgttgcattgtaagttctactcaaatagctcattaaagtcacatgctattagtagtttgggtttacttagcagatatctcatcaatcagatcctagaagtctagggcagcctacatgagtaggtgtgatgctagtgctaccaacaggttcaggaatagaaaattcagaaaagatcaagcaaaatcaattaagaaaataagcctttggctagagggtttggcacataaagttggatttaaagttaaaataggaacttgagttactgagaagcagatgacactctatttcatgttaatccaagaataaattgttgaacaaagaaagaatggcaaagacaaatgttctactgttgtccctttgaatattagtttgttggttttccggttctggtaatggtggaagaatttttcttggattaactctcattaaggcagcaattatgagatccatgtttatgcagtttttatcccgatatgggtgccaagaacatgaaatgtggggcagttagaaatcaaaaggaaagcttggctttaggggtcaaatagtggaattcgaggatggcaattcagatagaatttaaggggagagactctgacaaagaggaagctacagaaggagagtcctcaaatctgcctataaactgctttcaaatcttgtatgatctgaaccatgcatgtagtggggggtgggcaggaaaagaccccaaaaatcccaggagaaaagaggggatagaagactgaaaatgctgcagttatttcagtagatattcatggcagaaaagacagtttggagttttaaggtggcttggtgaatatacggggcttaccactgaaactccagaaggatcatgtcttagaggtaaaagttatgtttccatattaagggattcaccttaggacaatgggaaaaactgaaagagagtcacactaacagagcacaaaatcaagcctccacaagttcaatttgatcatcgaattatttataacacaccttcttcagaggaacataatggaatccagggtatctacaatgaattatccaaaatatctagtataaaaatctaaaaaaaattgatgatagctgttgagaaacaggaaaatttaatctataataaagagataaagcaattagtggaaaatgacttttagatgacccagatcatggaattagcagataagcactttaaagcagccattataaatatgttcaaggtcttagaggaagaaaattgccaaaatgattgaacagttgtggaatctcagtgaagaaacagaatctattaaaaaatgaacactttagaatttaaaggttaaatattagaaacgaaaactcaatttagaggcaagatgactacctggatgcaactaggaggaacatctaccactgagagaccaggacactgggaagactggcacacttccagcagatctttgtaaggaagacattgagagtggatggaggggtgacacaggcactgggctgaagtgggaggaagctgggaaccctgcatggggctaccatgcaatgggactcattcctggcctccagtgactcttggggaaggggtgaggtaagcaggcaagaaggagcctgtcttaatatggacctctggaatcctggcagcaggagaccccatgacctgcatgggcacctgagctggcagggagagttgcttagagaggtagtaggggcaggatcccagcctgtgtggagtctagagtgtctggtgcagaaacatcttcaggggagcatgacccaggcacgctcatcccccaaggcttgctatgctctcctaggagattctagccttaggggaactgtctaacctgaacagaggagggcaatcttgaccatgagatggggccagtaggacctgagctcatttctgtctgctggcctctcttggagacccaatctggcagtgcctgcttgcagtgcagctttagatgcccaaccagggcaggggcccacatcatagctcttgcactggctgagtgtacctgaccattgaaaagctctagcagagtggcctccaccaatgtggaccagcccactcacacccttccctgactgcagcctcccctgtgccacttggccaacacacacttgcccacagccaaagcccccattgctttgctgatgcacgtgtgtgaaggtaggcctcacttccccttccctgctggtgcatgcatgtgtgtgcaccctaccatgccattgctgccagcacaagcgcacccacccccatgctgcacggacaccagcaaccttgccccctgccccataccaccaccaccagcagcatgaacatgtgcacagaggtcaccagccctgcatttgtgggcaccctgtgctgactcctctacccccacgataccaccactgcttcagacaacccccaaacagaggctggaagccctgggcctcccagcgctccacaccacccaatgtgcgtgcaccctgccacactgccactgctgctagcacatgcaaacaagcacagatcctgctgacaccacctgataaattgctttggctggtaccatccttcaaagtgttgtggccagtggtctcagaacacctcagccccttcagcacagcaggttctcaccttgaggggccagagaacaaagccaggtacccgataccagctccctagaattagagcatgcagtccaggagtactgaactgaaccttggctccccacaaccccccaaatctaccataaatgaagcccatcagctgaactcaacttatgccacaatcaaaccctcaggacatcaaagaagataaaagcaacaaaacaaaacaaaacaaaacaaaacaaaacctaccccattcaaaggacaggaacttcaaagactgaaggaagatcagcccatacagataagaaccaatgtaagaactgtggaaactcaaaaagccagtgtcttgttacctacagatgactgcactaattccccagcaatgattctaaaccaggctgaaatgtctaaaatgacagaaatggaattcagaatatggataggaatgaaggtcactgacattcaagagaaagttgaaacccaatccaaggaatccttagaatctaaggaatacaatataatgatacaggagatgaaaaacaaaatggttattttaagaaagaaccaaactgagctgatagagctgaaaaactcacttcaagaatttcataatagaattacaagtattaacagaggacttgaccaagctgaggaaagaatctcagagctcaaagacctgttgtctaaaataactcacataaaaataaagaaaaaacagtaaagaatgaacaaaatatctgagaaatatgggattttgtaaagagaccaaatctatgacacattggcatccgagaaagacagagagaaaaagcaagcaacttggaaaacatattttaggataccatccataaaaattccccaacctcactcacagagaggccaatattaaaatgcaggaattgctgacaacctctgagaaatagtacataagaagaccatcaccaagacacatagtcatcagattctccaaggtcaaagtgacagacaaaatgtcaaaggcagctagagagaaggggcagttttcctacaaagggaaccttaccaggctaacagaggacctttcagcagaaaccctacaagtcagaagacaatgggacctatattcagcgttcttaaagaaaagaattttcaaccaagtatttcatatccacccaaactaagcttcataagcaaaggagaaataagatatttctcagacaagcaaatgctaagggatttcattaccaccagacttgccatacaagaagtcctgaagagagtactaaacatggaaagaaaagactgttaccagtcactacaaaaacacacttaagtacatagaccagtgacactataaagcaaccacatataaaagtctgcataataaccagctgacaacatgatgacaggatcagatccacacatatcaatactaaccttggatataaactcgctaaacaccccaattaaaaggcacaaagtggaaagttggataaagaagcaagaccaaatactatgctgtctttaagagacccatttcacatgcaacgaaacacacaggctcaaattaaagagatggaggaaaacctacaaagcaaatggaaaacagaaaaaagcaggggttgctattctaatttcagacaaaacagactttaagagaacaaagatcaaaaaagacaaagaggaacattacataatgataaagggttcaatttgacaagaccaaactatcctgaatatatacacacccaacacaggagcacccaaattcataaaccaagttcctagagagctacaaagagacttagataaccacacaataatagtgggagacttcaacactccactgataatattacacaaatcatcaaggcagaaattaacaaagatattcaggacctgaacttgacacatgaccaaatggacctaatagacatttacagaatactccacccaaacacataaaaatatacattcttctcatctgcacatggcacatactctaaaattgaccatacaattggacataaaacaatcattgacaaatttttaaaaatcctacaaaccatacttttgaaccacagtgcaataaaagtagtaatcaatacaaagaaaagagctcaaaaccatataattatatggaaattaaacaataccagctgtgggtctgtcatagatggcttttattatgttgaagtatggtccttctatatccaatttttttaagggttttttaaatcatgaagggatgttgaattttatcagatgttttttcagcatcaattgaaataatcgtatggtttgtatccttcatcctgttgaaatgatttatcacactgattgatttgcatatgtgggaccatccttgcatacctggaataaagcccacttggttatgatgaatgatgcattgttgaattcagtttgctactatcttgttggtgatttttgcatcaatattcattagcaatattagcctgtagttttctttttttgatgtgtctttgtctggttttggtatcaggataatactggcttcgtagaatgagtttggaagtattccttttcctatatttttcagaatagtttgagtaggattggtattagttcttctttaaatgtttggtagaattcagcagctaatccattggttcccaggcttttctttactggcagactttttttgtttgtttgtttgtttgtttttgaaaaactctatggcagactttttattatggattaaatctcattacttgtcattgatctgttcgggttttggatttctttatggttcaatcttggtaggttgtatgtgtctaggaatgtatccatttcctctaaattttccaatttattgcagatagtttggtcatagtagccaataatgaccctttgaatttttgtagtatcagttgtaatgcctcctttttcatctgtgatttatttatctgggccttctcccttttgtctggctaacagtttgtcaattttgttttattttcaaaattctaacttttgttttgctgatattttgtattgttttcttcacttcaaatttatttatttctgccctggtctttattatttctttactttgggttcattttgctcttgcttttccagttttttaagatacatccttaggttatttatttgaagtttttcttcttttttaaatgtaggtacttatagctataaatttccctcttagtactgcttttgctgtatatcataggtttcggtattttgtgtttccattattatttgtttcaaggaatttttcagttcccttcttaatttctttattgacccactggtcatgcaagagcatactgcttaatttccatgtatttgtatagtttccaaaattcctcttgtttttgatttctaggtataactaaaacactatagaaaaaatataataatctgataaaaaatggacaaaagatttgaatagacatttctcaaaagaaaacatacaaatggcaaataggcatgtgaaatggttctcaacatcatagatcatcagagaaatgaaaatcaaaactacaatgagatatcatctcaccacagttaaaatggcttacatccaaaagacaagcaataacaaatgctggcaaggatgtggagaaaagggaacccttgtacactgttggtggtgatgtaaattagttcaatcactatggagaatagcttggaggtgcttcacaaaactaaaggtagagccaccatatgatccagctatttcactgctggatatataccccaaagaagaaaaataaatatatggaagagatatctgtactcctatgtttgttgcagcactgttcacaatatccaagatttaggaccaacctaagtatccatcaacagattaataggtaaagaaaatgtggaacttatacacaatggggtactattcagccataaaaacgaaggagatcctgtcatttgcaacaacatgaatggaactggagatcattatgttaagtgaaataagccaggcacagaaattcaaacattgcatgctatcgctaatttgtggggtctaaaaatcaaaacatttgaacacatggagatagagagtaggagggttaccagaggctgggaagggtagtggggggtgggggcaggggaggggtgatgatggttaataggcaccaaaaaacagtttgaaagaatgaataatacctagtgtttgatagcacaacagggtgtctactatcaagataatttaatcatacatttaaaaataactaaaagagtataactggatggtttgtataacaaaagataaatgttcgagggggtggatctcctattttccatgatgcgattattatgtattgcatgcctgtatataaatatctcatgtaccccataagtatatacatctactatgtacccacaaacgttaaaaattaaaaaatattaaaataaaagttggccaggcatggtggctcatgcctgtaatcccagcactttgcgaggccaaggcaggcagatcacctgaggtcgggagtttgagaccagcctgaccaacatggagaaatcccatctctactaaaaatacaaaattagcggggtgtggtggcacacacttgtaatcccagctccttgggaggctgaggcaggagaatcacttgaacccaggaggcagaggttgtggtgagccgagattgcgccattgcactccagcctgggcaacaagagcaaaactccatcttaaaaataaaataaaataaaataaaataaaataaaataaaataaaataaaataaaataaaataaaataaaagtttaaaaaaggaaaaattattattacttggaggccagtagaaatcaaaacaaagaaatgaaaactccattggatgagattaacagccaactgagaataatagaagtgagggtaagtgagcttgaagatatgtcaatcaaaattattcatatgaagaacaaagaggaaggaagactgacacaaaaatgaagagagtatttataacttctaataaattataaagcatttaaaatacatgaaattagactcttggaggagaacgcagaaataatggagtataaaaatattgttaatataaaagtttaaacatttccaaatttagtaaaatatgagaaacaactagtcaacaaacaaacaaagaaacaaaataacgaatcattaatttacacagcaaagaagcttagcaaacacaaagtaggataaattcaaagaaaaccacatttagacacatcatagtcaaactatgaaaagacaaagctaagacataatattgaaatcagcagcaaaatgatagacagcttataggaaaagattaaaaaagaaaatagagactgaaagaaactggaattacatcttgaaagtgctaaaaaaagacatttttagataaacaaaagctgagaaaatttgttactagaatacaaagctacaagaaatgctaaaggaagttattcagtctgaggaaaattatagatgaaaactctaatctacctggagaaagcaaagtcatcaggaatgatgaacatgtaggtaaattttaaaaaatattctcccactacttgatatttttaaaagccaactgactaaagtaaaaaccattgcattgttcagttcatgacatatgtagatataaaacagatgacaataatagcagaaagagcggtgggtatataaacttctacctttcaaggtacttattttttattcgaattggtaaaatatttactctaagtacaccatgctatgataaagatgcattgtttaattcttagagaaactactgaaaataatacaaagaggtaaaaataaaaatccaatagaggaaatattataaaacggaataataaaaattattagattgagccaaaggaaagcttttaattggaagttattgcttagtctacttacatttcatgtaattattgatatggttaggtttaaatctatcattttgctagctgttctgcatttttttctctctgtttctcctttattgttcccacttggattaatgcaatgatttttttacatgaaaaagcaagacacaactatatgctaccttagctttaagtataaagatgttttcataacaaaagtttaaaaaatgtaaaaatatatacaatacaaatggtatttgtatatacaatataaatgcataagaaagctgaattgattaaaatatcaggcaaaatagaattcaagaaatggaggattactgaagaaaataaagacatttatcctgataaaagtgtcaattcatccagaagacaaaaacattccataatgtatacctaataaaagagcttcaaaatacaaaagcaaaatctgacagaactaaagagaaaatagatacatgcaccatcatggttggatatagtaacattcttctctcagtaagtgagagaccatctaaataaaaaattagtgagtatatgaacaatctgaaaataaaaaaagctggttctttgtaaagattgataaattagatgaaatcgaatgtaggccaatgaacaaatgaaagagcaaatacaaattataagtatcaggaataaatgcagggatattatcccagatttcacatacattaaaaggatacttagggaatattatgaataattttatgccaaaaaattgacaaattagatgatatgaactaattccttcaatgacacaaattgccaaaactgatgtaaaaactataaaaatccctattaacatgacatttataaaagaaatggaatgtgtaataaaagtacttacacacacacaacccctagatcacagttcttgctgatgaattatgtgaaacatttaagaagaaaataacattcatctaacgtgaaagttttaagaaaataaaggaggaaggaatctttcctgatgtgttttatgaggccaggataatacagctaccaaaatatgagaaaggcattaaaagaacaaaaaataaaaaaccaatatctttcatatagccacacatagagaattctttgtacaatattaacaaactaattccagtagtatattaaaaatgttaaaaagataatatatcttgaataaatgaaggttataccaataatgcaagattggtttaacattaaaaattaaattagaactcaagattaagaaactcactcaaaaccacacaactacatggaaattgaacaacctgcttctgaatgactcctgggtaaataatgaaattatggcaggaatcaagaagttctttgaaaccaatgagaacaaagcaacaaagtaccagaatctctgggacacagctaaagcagtgttaagagggcaatttatagcactaaatgcccacatcgaaaagctagaaagatctcatattgacaccatagcatcacaactaaaagaactagagagccaagagcaaacaaaccccaaaggtagcagaagacaagaaataaccaaaatcagagtggaactgaaggagatagagacacgaaaaactcttcaaaaaatcaatgagtcggaggacccacagacgctctgaaggaggcagactgctcctgcaggacccaggagaccccctcaaaactgtgagtgccccaactgctgaagtgggaaacagagaccctcctttcccaaacacgccctcactggagaagctgaaggtctgtttgcgggagaagttctcgattttacctggagctgagtcaatttgcagagctgagtgaaatacaggggtagaggaaatagctatagaaaataggcaaaatttatacaagaacaatataaatcatgtatgatattagaagaattataaaactttcattcatagtggattttgttttgggtttttttttttgagataaggatcttgaaatcctgggctcaagtgatcctcccacttcagcttcccaagtggctgggactataggtgtgtacccctatgcatggcccagagttttcttataataatttttcaagttgcctatgctagaatatctgccaaaatgagtattggggtatcacattgcagttcatgggaattatttaaaggaatgtattacctgataccaaactaaacaagattcagattcagaattgatggttgtataaaaactatgtcatgtacaaataaaatgttatcatattgttagcctcaaaacttggtccttataagcaccttttgataaatgatcttgagtaaaggactcacatagcaaaagccccccttacttaggtttgcttgttaccaagcaaaagcaggatatttaaaaaataatattgtttaacaatcatctagtacattttctttgcaagtatttttatatacctcatcacatcgttttcattaataccgtttctcttttgtgaaatatgcatgcataaaatgcatagactctacatggatagtttaataaataattataaaggaaagctcatatatttacactcaggcaaagaaactgcaagcatcagaagcctctcactagggtctccctcagcaaaagttcatccttcttcccagagttggcactattctgaattttgataattattttctttattgttttactacccatgtttgtactccttagcaatataaattagctttgtctggtttttgaattctttcctatctttttattttgaaaaatctcaaacctataaacaggtagcaaaatagtgcaatgaactttttcatattcttcacctagactcccagttgttaacattttcccatgttttctttgtgtcaagagatggatatacatatgtactttatttgctgagccatttgaaaatatggcaaacactggttttgaactttgtataaacagacttatactatacatattattttgtatctctttttctttttactgtttataaaatttgttgagattgattcctccccacccccacccctgctcaaaaaagaaaggtagggctagtggttttcatgaaggaggatatattgtttggaggatctgggtaattttaaattataatatggaatctagagcttagatctaaggattattcctgaatgaacactttttcagaggaaatttcgtaatacatacgtatcaactggaatgaaaaccaatgatacgtacttagagtgttacacgttacaggccaggatgtaaacttggattaggattgtaatctcaacgctttgggaggccaaggcaggcagatcacatgaagccaggagttggagacctgcttggccaacgtggcgaaactccgtctctaccaaaaatacaaaaaaattagccgggtgtggtggcgggcgcctgtaatcctagctactccggtgtctgaggcacgagaatcacgtgagcctgggaggtggaggttgccgtaaactgagattgcgccactgcactccagctgggtgacagagtgctgactctgcccccaaaaaacaaaaccaaacagaaagaaataaatggatttaataatctaattcatacttcctgttggtataataccagttaatttgtttactaaggagggtgaatgattcatcttaaaaatggatgtttcttaaaaactaagtctcaactacagcaaaatggatgaaaaatttgcataaaatgcattaagtgggaccaaatggtcaatcagtaatgtctctagccatggttgcctggagatattaacaatgttacactgggaatgaaatgatgctacacaaatggaaacttctcccaagggggaaaggattcttcaagccaaagcctagagcagcataagaaaccatgcacagataccacaaagttaatttagttgttcctagcaaaagaaactcagaactctcaggttgtagagagagaaattccatattaatctttcattggcaccaatgaataaagacttaattttgagcaaagttacctgcaaagaccaagacttggttattggggcatgaagcaagaagagccatttgagagcagacaaaatgatgatgaaatgtgttttttgaatatttactatgtgccaggctgtagtccaagtattttataagcattaactcatttaatcccttgaagtgggtattatttttgttttatcatctgcattttacaggttaggaatttgagactctcaaagattaagtaactgggacatgtcaccctagcatatgagacacctactaaggcaagactggacaagaatatccagaaaccacactgatagttttcagactttttagggaaaagccactcggaatggatatcataggagctgtgttagatttgtagttatgtcaatacatttaatactagttttcaattgttataagttcattataacaaattaccatgacaaactttttttttttttgaggtggtgtctcactatgttgcccagactggccttgaactctggagttcaagtgattcttccacctcagtctcccaagtcattgggactacagttgcatgtcatcatgccctgtgacaatcatttattatctcaggatttctgtaggtccacaatccaggtgggctcaactatgttctctgctttggttgtcacgaggccagaatcaaggtgtcagaaagcctgggatcttatgtggaggctctgggagagaatctgcttctaagctcattcaggttgttggcagaattcagttccataaggttgtagaactgaggtctcatttcctagctggctgttggccagcaccattctttgctccttgaaactgtgcaccttccttgcctcatggcttcctccatcttcaaagctaacaacagtatattgactccttcttgtgagttgaatcgtcctgacttccctctctgcctttctcttctgccactagtcaggaaaagctcttcactttaagacctattttccgattgggttgggctcacacagaaaatctcagatcttaaggtcaaatgacatggacatttaattacattagcaaaattccttcacaatggttctgggttatttcattgtccggagacaagaagctggagagagtacctttagaattctgcctaccataacttagtttctggttacttaaatatttcagcacaaggtaaaatagaggtgatagaagtagatatggaaatgaggggagtgctgactacaattaatattcaatttttgtttcaatttaaaaaagtatgctcttaccaaaaatagagagcagtcacaaagaaagggatattctaattaaacacctttagggatagacaattttcttccttctttcacttaattcttctaatactaacttcataggcatgcagtggagccaatggaatcactaattcaatcagttaacattcaatttttagtgctttctttaatctctgtgcgtatagattgggatagctgaggtgcacagggattcgagagctgtgataaacacctcattgctctctgttcagagtcttcacagggcctagatcaaagtgttggctggcctgaactcttatctgaggactttgagagagcatctgcttccaacctctttcagattgctggttgaattcagttccttgtggccatagggctgaggtctctgtttgttggttgttagcagggagcctctctcagttccttaaggccgtctggattccttatcacatcgttccctccatcttcaaaccaatgatggtgcattgagcacatctcttgtttcagattattctgatttttccttctgctgcatctctttgactccagccagagaaggtgctctgcttctaagggttcatgtgattaaattgaacccacctgaacaatccaggacactctgtttcaaactctgtagtcttaattatgtctgtaaagtccttttgctatgtaatatagtcacgggatacaggggttagagcatagacatctttgggggccattacattcccaaagtgatggaatatgaagctgggaagagaagctggagtaacattctgaagctcaaatgtctgctaggaggcctacgagtcattctctagactcaagagcattatgtcattgaagaattttgatctctaagaaagacgatcgggagcactgtagagaagttaggctggagaaagacaacaggacccagttcaaaaattattgcataattcagggaagaaatgctgaagacttgggccatttcatgtgtggtggggcaagggccttgttttctttatacttggttaatttttcacctggaagtcctactaaagcttcagatttcacagctgatgttatctcctaaaaaaacactctcaagtatgttctctcctaataccctacaaaatactcttcacattttatggtgattacttatttaattgtgtatcttccctgctagatttcctttgcctatcttccctgcttctgttttagattcgtgaaaagagttattagttctggcccattcatttctgtgtatttggcactaaataatttatattgcatggaagttactaagcaatttggtttccagcttgggtgttttggtatagggctcagttatgaactgaagtaggaaatatactccttatgcttcatctgcttcctaatggaaaacattgggcttgccttgattccattgctgaaatacttttaaactttgtatgaactttaaagccagcagaggactgaatgtgttaagtgatgacactaaattctacgacacacattgaatttaccatgtttttcttaacccaatttgccttgtgagatggcgtgtgtgtgtgtttgtatgtttaaagccattgtgtttgtccatctgcattgcggattggtatacattaatgaagtgttttgcaatagaactcaatatttttgtatatttctaatgataaggtcgaacctggaaggattatcttatgatggaaaggtttttatagttgcatcaatacttaatttagcaatagttgttcaggtagcttttttgagctgacactactcagaggaagacctcattttgtcattatcagatacgggcctgaccaactggcaaagagaataacaatcagagaatgtattgatttcctttagcaagttgaagacattaccgtcattagttctaaggctttggatcatttaggaaggttggggctccttgaacaagttccctgtaactctcttcagtttgtcaccttattaacaaagtttttctttttttctttttccttttgaactgtaagagcaactgtataatctaatatgaatgttttatgaaatagtattgtcaaccactgatgttttacggaaatgcacactgggtggtataattatttaaagtttaaaatgtgctgaacagagctctgttttaataagcatttcagaagttgaatagactgaagttcaaaggacaaatgctttttaaacaaaattattcatttcatttcccatgtttgaaatgagtagtttaaagctgctattcaagctataaaggatttcctttgtcttaattgttaatacaattaactgcagtgtaatatctgctggtttgaacaataatattatacattaatgaggtttatgctaatttttatcctcagacatcaattttccagataaaagcacacacaaattttgcatttttcctttaatttaaattcacataaatatttgtttactttgcttagtatccatattatctaatatatgagcacattataatcagttttaaattttttctttcattgaatctagtttatttcaggagcaccatgagaacagcaatttttgagcaagatcaatggtctttcttctgctatatggcagatacttagaatatatgctagtacggactgtttgcctctttggaaatgagacatctgaggtggagtttgagatagtctcaggaaaagacgaaggtggaggaagcctgcaaaatggtgctggagttagaatagctataaagagaatgagtgagacacagtgatactagaactttcctgtatttattcttatataaacaatttaaaaaaatattttaaatttaaaagatttatttggccaataataattgtacataattatggggcacaatgtgatgttttgatagatacataaaatgtgaaatgattaaatcaagctaattaatatatccatcatctcacttatcattttttggtaagacatgaaattttctctcttaacaacttcaaaatatacattattattaactatagtcaccaagctttgtaatatacctcaaaaacttatttcttctaagtgaaagtttgtaccttttgaccaacattggaaaatctcccctttaaacatgctagcaaatccttttgaaaattagcttgaaattttaacacaaataagttgaatacattctaattagtgccactgaagcttgatgggaagatactcagtgaaaaattgcaactaatgctaatattctgttcaaaaacagattgaacaggagaaaaaacatcagaggttgcagagatacagagtgaaaaaaaaaatccatgaatctccaggcaaaagcatggtgaggagaaataccaaagtaacataattgtgagaatcccatatgaactgtttggtcacatggagcatatgaatgatactttcaacacccatcacacaagtgggcacattggcaaaacaaatcttaatggggatttgaattttcaagagatatgtctaaagtctcagtgttctgaaagcagagcatatgatgaattcttgacttgcctaacaattttaccttatcggcaactgaagaagcaatgaaggaaagctttctctggaattaggattgcaaagaatatgcattatgtatgaggtattgtgatttcagcaaaacatatggcaaaaatgatttaatctacaaaagtggattaaatgctaaaatagggatatggaccatactgtaaaggcaggttcatattcataactggttgaataactcaatgcaaagtcttgattggggatcattgttaacctaaagaaagatctctagtgccttgccacagaactctgtatctgcttctgttcctttctatatattgagcaattatctggatcaagacacaatagttttgcttgtagaatttgctgatgattcaattctgagaaagagaacaggtaagatgaataaaagactcaagattcaaactcatatataggttggaagaatggccccaaagtaataagatgaaatttaatgggggtaatgatgaagttctatacattgatttaaacatagaaacattcatagaatttccactgtacaattcataatggtgaatggcttagtattatagcattattatgaaaaagactcagccttttattgcactgccaactcaacatgggccaacactatgatatggcagccagaaaagcgaatgactatgttgggttgagttaaaggaagcacagagtacaataaaagggagttagatcattccaaaagcactctgttaagtttttgtgctgcttttttttttttttttattgatgaactgctaatgtccagaggggaaggcctgggtaatatcatgtcacatgagaaaagatggaacaaactagggctattgattctagaaaagaagaaacttaaaagggataaaaaaaagagtgtctatttattagaaatgattctaataatgatctaataatgattaggcttcctctgtacatttagtacctagcacagcctggtacacagtagataccaaaaaaaaaaaaagttgttaaaattcattcaatgaaaaattattttcttatatggcagttattattttaagtgctcagtatacagcattgaacaaaacaaacatggtccttgtccttgtagaacttatattctaaggagaggagagagaagataaactgaacagatagctacataatgtaataccagacagagagtggttaaaagtgagggctctggaactggactgcctggcttcaaatctttgctcacgcttaccagctctgtgtgaccttatacaagttatctactctttctgtaactcaattttctcatatgtaaaattgagatattaatagtgcctacctcaaagagttctgtgagggttaaatgaggcactccatgtaaagttctgtggacagtgtctggtataaagtaagtattcagtaataactattattgttatagtcataaatgctctgaagaacgaaaagcatggtaaggtgacagatcaaagaatgggaaaggaacatcattccagagaattgtgtgtagaagatacatgaagacacattggaattatgacgtgtcatatttctacaccatttcacatgttcatcttcccccatttgtcctccactcctttatttgcctggatgatctccgtttaccttttgaaatcaagctcagatagcacctcacctagaaggctgaactgatcccctttgctactagagctggctattctctcttccatgctacttttattttttaaaatttatcacaaggtattatattaaaatgtatgagaaggtctaaggcataatggttaagatctcagattttggaatcagatagaactgagtttgaattaccaatccatcacttactgactgtttgaccttgaataaccactatatctctccaaaccttggttttctcatttgtaaatttgggataataatatatactctataaggtattttttataattaaatgagaaaatgtatgcaagaagcagtacagggttttaatcccagctccatcccttagatatgtgaatttggagaagccattcaacttctcaaaacttcatttttcttaatctgcaaatgggagaattaatcctttcttccagagttattgtaagaattaaaaaatgtatataaagcgcctggaacatagtaggctctgaatatatgcttgtcaaattgagtttgattggcaatcagagcttttagaaagagttgccttttgaagccataagttccttgttatattatgaggtggtcatagtagatggcaatatactggagacgttgtagaggggattcctgcaatagcatagtggatggatgaggtcagtacttcccaaactttcatccatagaccagttgcagcaaccccatcaagtctaaattaataggtgtgggatgagaaccatcaatctaggtgactactaaattgcctccaactcaaaggttaatgattctgtaaattagaatttagttcataagttatggacttcattaatttcatcaaatgaactcctctctgtatcctttgtacccaggctttcactttttgcaccgacgcatattattaaatggtttcttaactacactaagcccaagaaaaatgattttcatttatcttcatttatttatttatgcattaaatttaagtagagtcagacattcaagaatcatgttttcatgctgtgtgagataattggttaatcttagtttaagttttcccattattcaatatgcttactttttacttaaaactgtgttaccattgccaaaactttcccaaggcaacttcttgaatctgaagttgcagaattacaagttgccaaagtcaaccatgacacaagtgtagaaggtaagagaacttatatcatatggccttgggcaaacacctttgtcctgctgtgtgtcaacttcctcatctgcaaaatgggaagaggaaaatgcagataaggtatttcttataaagctttttaaatatgagaaaatgttatctactttgtgattttcattaattttgatattacagatttttttctgaatttttgcatttggattcatttttaaagatttgcatattttaaaaatgttttgaatacctaaatatcaaggtacagagatgttaatacctggtagaaatttacttgcatttgatactaatgtacaaaagacatattgaaggaaatatagctaggaaattaggaaaaaggagagggaagttgaattggggaaagaaaggttttttcaacagtgtggactcattgaaaatattaggggaacaagctgaagttttgaactcctctacttgggaaaatattttagaaatgcttatttccaatttgtacgtattttgggtgtcgtggctccttatggcttcttttcttttctcttttctttttatttcataaaaaaaaaaaggaatatatgtgcagaacgtgcaggcttgttacataggtatacgtgtgccaccatggtttgctgcacctattgacccatcctctaagtttcctcccctcacccctcaccctgcaacaggccctggtgtgtgttgtttccctctctgtgtccatgtgttctcattgttcacctcccacttatgagtgagaacatgtggtgtttggttttctgttcctgtgttagtttgctgaggatgatggcttccagcttcatccatgtccctgcaaaggacatgatctcattctttttttctggctgcatagtattccatggtatatatgtaccatattttctttattcagtctatcattgatgggcatttgggttggttccatgtctttgctattgtgaatagtgctgcaataaatatgtgtgcatgtgtctttatagtagaatgattaataatcctttgggtatatacccagtaatgggattgctgggtcaaatgctatatgtggttctagatccttgaggaattgccatactgtcttccgcaatggttgaactaatttacatttccaacaatagtataaaagcgtcctatttctccacagcctcaccagcatctattgtttcctgactttttaataattgagattctgactggcatgagatggtatctcattctggttttgatttgcatttctctgatgatcagtgatgttgagcttttcttcatatgtttgctggccatgtaaatgtcttcttttgagaagtgtctgttcatatcctttgcccactttttgatggggttgtttgttttttcttgtaaatatacttaagttgcttgtaaattctggctggatattagacctttgtcagatggggagaatgcaaaatttttctcccattctgtaggttgactgtttactctgatgatagtttctttcactgtgcagtagctctttagtttaattagaccccatttgtcaattttggcttttgttgcaattgcttttggtgtttttgtcatgaagtatttgcccatgtatggctgcttttcatgtcctcacaacatggacatgtatgagccaattatgataatgtggttgttatcagggtcttagagagtctattttgaaggaatccaaagcagacttgaaaagtatctctttatactcccttttaatgtctttgtaaaatatatttgaggatcaagaaatatctgggttttaaacaaaaggagctataaacatactgggttttattataactgacaaatcctattaggtatttataactcttccgactcttgtttctttctattttaattgttagtatttctttgtcctacaggaaagacactcttggttatattttgacaagtcacctttttttattctcatttttctgcattacttagttgcagagagtggatacaattcaacaaggttaagagagataatctcttgctaaaagtaactaattctgcatcatttccaattatgcaaagaattgaacagtaaatcagaatttttccatactctggaagaagtacttaattttaactgaacgtcaaatcgttaaaggtaacaaagatggagtgtacgcagaagcacttgtgaaagagttatgattctattctaattataccaatttatttttttaatgaaagtattctcctgtaattattttgataaattctcttaacaccctcctccttctttgctccgcagttattatcccactggtagccagtgcaggcaattgccagaattatctttatatttagtccataagaagtttataattttgcaagtgaccacttaagtgatgagaacattcccaggtcccttgaggagttatctagttgcttggctttaaagttgtttgacccataagaggtcatgaaaggagactccacttataaatttctatgcatgtatgatatccttttagcttgttcttgctgctgaattttgattgccttaactttatactcctggtctttgaattagtaggttaaagtctgttttttacagaggtatacttagctgaagtagtcaccgtgtcactttatgtttcagtttctagggataaagttatttatttgtttatgcatttaagtgttttgaaactcatatgactcatgactatttaagctactcaaatgtaactgtttattctgcttccagaagtaaatgttgccttgaatcaatataacactcttttgttcagtgtcttgcccagtgctctcagaaactgcttggatagtacaatccatatacatattttagcatcttgtccctaataatcatagagcacttttgttatatattttgctgaaatcaaaatactttatgagtgtgcaatacatattcttgacaaccctactttcggagaaatcgttttcttcattccttcttcaatgaagaatgactataaggtaaaattgttaggcaagtcaagaattcatcatatgctctgctttcagaatactgagacgcatagttcttgaaattcaagtccccattaaagtttgttttgccaatgcaccagttagttgtgtgacaaatactcaaagtatcccccatatatcctccacgtggccaaacaggtcatatggaattcgcaagataatgttattttggtatttctcctcactatgcttttgcctcaagattcatggatttttttttgttctgtaactttgcaacatctgatgcgatttctatttttgaatagattattaccattaattgcagtttttcattgactatcttcccaagtctcagtgacacttagtcaactttatttaacctctttgtgtgagaatttcaagctactttcatttactacccatactgttgaaattgtgataaaacatctaagggtaaaactatgggtcacaagtacctttcctatcatttccccatgacaattattgagataattttccttttttttttttttttgcttttttcctgtactttcataatcagattcaggcacatatttttttgttgttgttattttgttttagattcaggggtacacatacacatttgttacatggatacattgtgtaatggtgaggtttgggcttctagtgtaactatcacccaaatattgaatattgtacccaacaggtaatttttcaaccctcacttcctctcaccctctcccatttttgagtccccagtgtctattatttccattttttatatccacgtatatcgattgtttagctcccacttataagtgagaacatgtggtatctgattttctgtttatgagttactttacttaggataatgaccttcagcttcatccatgttgctgcaaagacatgattttgttcttttttatggctgcatagtatatcatggtatatatatacctcacatttcctttctccaatcaactattgatgggcacttaggttggttccatgactttgcttttgtgaatagcactgtaataaacatacaagtgcagatgtctttttgataaaatgatttcctttgggtagatacccagtagtgggattggtgggtcaaatgatagttctgtttttagttctttgagaaatctccttactgttttccataggggttgaactaatttacattctcaccaacagtgtataagtgttcccttttctacatatcctccccaacatgtgtcttttttttctttctttctttttaatagtagccattctgactggcatgagatggtattacattgtggttttgaattgcatttctccaacgattagtggtgattgagctttttttcatatgcttgttggccgcatatatgtcttcttttaagaagttctgttcatttcctttgctcattcttttaatggggttgtttgctttttgcgtgttgatttgtttaagttccttatagattctgagttttagacctttgtcagatacatagtttgcaaatattttctcccattctgtgggatgtcttgttcactctgttgatagtttcttttgctgtgcaaaagctctttgtttaattattagtttgctgcaaaagtaatcgtggtttttgccattaaaagtaatgctctcaaccgcaattacttttgcaccaacctaataggtcccacttgtcaatttttgtttttgttgcaattgcttttggacatttaatcatgaaatctctgccaaagccgctgtatgaaacagtatttcctaggttttcttctagggttttaatagttttaggtcttacatttaagtctttaatccggtgtgagttgatttttgtgtatggtaaaggaaggggtccattttcaatctcctgcatctaactagctagttatctcatcaccgtttattgaaaagggaatcctttccccactgtttgttattgccaactttttcgaagatcagatggctgtaggtgtgcgactttacttctgtgttctctaacctgttccattggtctatgtgtcttttgtacgaccagggtactatttttattagaagtggtgtgcgtgtgtttgtgcacacacacacatatatacatgtttttttttttcacctccatacttaatagactaagaatctcattactttcctgtaaagatgtcagctttaaattttgccagttttggcaacggttttcacacagctgtatctgcttcctatttgcaaggtataaagaaaagaaattttaaagttttgttttgaaatctaaatggaagaggtgcttattaacaaggtgtctttttttatatgtgaaaaaccaagcatgctcattctactaaagagcaaacaattttagtcacactgtagctgtattatgtaaatcaacatttataatgggagcaacagcaacaattcttgtgatgtccaaatcagagtttggaaaaaggaggaggaaactcatgactgcatgtgggtattcggctctaaagtttgatgaaacttttcagaaatttgagagtatctcaggccagccactgatatctcacaaggtttggcatttaacaacacagatacacacacacacacacacacacacacacacacacatgcactcatgcacacacacagaaaacagactggaggaaacccccatggaggcagttctaacatcagtagacaaccctctcttccatgcagtcatagggtcccatttattgcatccatcaagagaaccatgttgagattgacaatccttcctgccatgggtcctatttcacctcccatttgacacaaagaattttgcagggcaccaacttgggattctgatatctgctttactcggattcagaggaaaaccaattttcaaaaatatgtttgtaatggctaccaacttgccaatgcatttgctgagctagaagttttcagctctttgaaattttatctcccatgtgctccaaggacttcccaagcaccacaacacctcttttagtgtggcacagcagacaggctagtgcacaatacaggcagcataaggctcctctcacctgcctcacaatggaaggggttttaaggcaaagtcagaaggaaaatcatttcttatgctaaataggccttccctttattctccttagtagcaatgagaaattctgagcggatgtgtagggggaaagaacacttaagcctgcacctgcaacagaaatgcaatttccctgctttccaatggattttactcaccattgagctaactctgtttgtgaccctgctggattttgaactcttacgcaaatgcaacaattacaggaagcccaaaggacgcccctcaattcattgtaaaaccgggtgtaggaatgaactctcccaatgagtaatgcagttacatgtctatgctaaagtgttccgacacagctttgaagtctttaatcataaatcacattcacaagcttccatctccgtctgtagcatgcatatagtgttgctacattaccattgaacttggaataaaagcctgtcttgtggagattatcataggacataagagattattctgctaccgacaggaaaggaagcatgctaaaaatgcatgagctgtcaaactagtgaacttgccatgacctggaacatcagaaatacactgactgccttgagagatgagcctttttgaattgtggttctatgagaagcaatagcacatagagttggaagagtgggactacaggaaatgaatttagaaatgagaccagagaatctttaatgtctctcacagcattcagattttctaagttaaaagtgataaagactaatactgctcacccagaaactcagaagaataattagggagtggaacctgagcgaggggaccaaatggaaagtggattacacgatggaaagtggattaaacgatataaagtgaagtcctaggggcaactagaaaccagtggggagggaggaatgtggcagcccgggaaagattccaccgtctggaagggaagaggaatacagatttcaaggaattcagtctactgcacatgccctttggccttatcttttcctttcttcatgagatacttacttctgacatgcaacaagaagaggaagtctccatggagagttctcccgagtctcaccatggatcttccatttcttgtaaggcttttaaattaaggcaaggatttattctgcatgacgcctgaactcctttttttactcaaagagatgatctgttaagaacagtttgggcacagtgggaggaagttggactgtagctccctaggctcaccattaatggataaattgaatgcttccatttgggacacgtaagacagggagtatttggagtctttttttagaagtacacttaaatgaaagatctgttaaatgcttttaaatgacaatatttcagttctttgtgtccacaaccacgtgttccatagggttccaagtcactctttattaatttgcaattacatgcaactcccttgtctctctgcagtctctttctgacatatgcacctaaagaggctctgagggggcgttgaggaagctaatgaccagctaggagaacatatttacactatgcagacaaatgagaaagagtcagtgcaaaagtcagtgatagagtacttgcagtgaactaaaagtcacttgtcgtgcagtggaggaacatttgcttacaactttaaggactgaatagaagcattgtgaatttgggcaatattttatgtatgctttatcttgctgtcagacataatttttctcaacataaaatttcaatcctatcttcaaagctccaacctcacagctcaagtccaggttttattatttttttaagaagcagttttatgtatcatcagtgttaatgaaaacattatgttcaattcttaagttgaattgtggatttgaaatatgaagttctcagaaccatatgctcatgttcaaaactgatgtctttgtagctgtgcctattcagagcatgaagatgtatagaagtaaatgcacatttgaatgtgcaggttatactttatcattaaggccaattatttatagaagcagagcaagcagagcactgtcaaaatggctttaaataaaacaaacaagcaactgcagaaaggtatggtttacaacaggaatgcttgccatgggatcctttatctttagtagaaagagctggccgtggctgctgcaagcaaagcgctttaaagcagctggacaaaatgctgcaggagggatgcagctgggatcttcctctctggagagaagatggatccctttgagggagactcagctggctaggaagcctccaatgcactagcaagctcagttctctctggtaaccatacagtattttccagaaaccatattttccaataaccttgaataatagaaacttcctaagctgtctggaaaataaaataatctgctcctggaaaggagtagtaaatgccttttagatctagataaaacatgtagctaaaatattttttaagtaacgatgatttgtgcagcagataataatacagttttctgactacaaagaatctaggctctgtcacttcatagctgtatgaatgtttgcaagtgtcttaactaacttgagcctcagtttcctcatctgtaaaatggcaataaataacggcatctttgcttatttttagagaaatgctaattcataaataaatggccttcccccctaagtttagagaaaatatctttaatattcttgttgctagtgacttactcctgttatttattatagaacttataagatcttgtcaatgaaattgtttaatctgctgggtgagccacttttggtaggtccagatttaagttcgataaatgtttagacattgtgaacaactgtgcctgtttcagtcttcactttccctttaagttttgcacctgacactctgcaatcctgatatttttgttgatccaattctccaattacttgttgaccagaatgtcactgtttatatggcccatcaagttccaattctaggagaacctattctcttctttgccaaagattgccttttgccaggtatagaatatttttggcctgactggataatctttgtacttatttataaaccataatgctggctataattattttcctgtttcacaaagagtactagctgcctaactaatatccattctctctttcttagttaataacttaacctgatattattctggttggccctggagaggtaagtgagagatgggatgcaatttccaggaactcttcttaagaaatagatagcatttggtatatatactctttcacttcccatttcctgcttcctgctgattatggggacataatggctggagccccagtaaccatattgaacaatgaggtaatcttgcatatggaagtcactgcaaaagatgatggattataaacataaaaactcatactttgtgaccttggagttacaattatcgtctctgagttgcctaccttggaatgacttttatgttagaaaaaattgatttttaaaatcttgtttaagcccctgttctttaaggtcttggttgatgtttctagatgatacagcacattttcctgagcatgtgttctgagaccacagccaacctagtaatattctagtagtggctatattggttatactgagaaaagatgcagaaaagatattataaatattgctgggtcagtgttgacagtgaagtttatgttttcagggcaaatgtcctgtcctttccccccagaacatttaattcaaatgaaaaatgctatgaatttagaccacagattttattgagacaatttctctagacaagtgcgaatggatcaggaccagaaattgaaagcctttgtgttagtattctatatttctgtgactcccaaataatagcactaccaaactttaaaaagcacaaactcagggattaaaataaaactataatcttggactgaaattttactcaaatagaatgtggcacaattctcaaaattgagattaacaaatgccttcttgtctacatttttccccctctaccagtgttttttgatcttctaggcctaatcttcttttaatgttttagatttgaaataaatatagattcacaggaagttgcaaagatagagtaaagaaatcccatgtacccttcactcagtttcctcccagtggccacatcctaagtacctatagtacaatatcaaaatcaggaaattgactttggtacaatatatgtatatagtgctatgtcagttaatcacatgtgtagatttgtgtacctaccatcacaatcaagatacggaactattccatcaccacaaagatctttctcatgttacccctttagagttatacccacctctcccttatatcatgcatttcatctttaacccttagaaagcagtaatctgtgttttccatctctagaatttttgtaattttgagaatgttgtataaacagaatcaaggttgtgaacttatgaaattggccttctgcactcagccattgctcttttagattcattcaggctattgtgtgtatcaatagtttgtttatctttatggctgagtagtagtccatgccatggatataccatggtttatttaaaccattcacaccttcaagcatatgcccattgtttctagttttgggctattataaatagaaatgctatgaacaaaggtgtacaggttttattttttattgttttgagacagagcctcacactgtcacccaggctggagtgcggtggcgcagtctcggctcactacaagctccacctcccgggttcacgtcattctcgtgcctcagcctcccgagtagctgggactacaggcgcccgccaccacgcccggctaattttttgtgtttttagtagagatggggtttcaccgtgttagccaggatagtctcaatctcctgacctcttgatctgcccgcctcggcctcccaaagtgctgggattacagacgtgagccaccgcgcctggcaggtgtacaggtttttgtgcagacatcagttttcctttctctgggataaatgctcaggagtacaattgctgggttgtatgacagttctatgtttcgtttttttaagaaaccaccaaactatattccagagtagatgtaccactttataatcaatccctccaatgaccttctggtcaaccatctttcctttccttgggtcctaaggttcttagccagtctggcttttttctcctcacttttcagagtcttcttatgtttgtcttacatataatccccaagatatactagttgtacttagcaggaggaatgggaaatagtacatctactccatgttcccagaagtggaagttttctctttattttctcttgaatcccacactgtttttcaatgctatatgaaatttcaaaataaattaactcataaagaaataaattaacttttgccaggtataaaatattaaaaagttaagacatttctgttttgttttcaaattaacacatcaaactttttccttcactgatatttatatatgccacccacctccttgagactcattgtcctgcacattttcaaaatttttgagttttaatttccaatccccctgcttttatttccagccatatcaccattccctagttggggtgctctttttgtactagtgccctattgtgaaccaaagcactgaaatcggtgtcagatttttggcccagttttttagaacaaagatgttcaatttcagataagttcagataagcattagataagcatccacacacttaatcaatgcttagttgaaccagcagccttcatcaaaattttgaggcctgcccatcaaaagagatttgcttttatcagtatttggcttgattcaaactaacctgctaaccctattgctttaaaaaaaaaaacaaaatgcaccagttcagaagcatcaggcttggaataagtgtaagggtctttcatatatagtttgagaatattttatcacactataccacttgtcaaatgtaattataaagggctattagatgaggttcaatttccacgtagctctatgtaaaggagacaagtttttcccccctcttctcatggagaggaatatatttgtattttctctaaaatttattgatttttcctatggaatgtttgagatcattgtatgaatcttcaactgcagtagaaacataaaacgttttataagtggtgttttcatcatgaaaggtgtaattacacacacaccctttacgcatatattttttattggttttgtggttagttgattttaaagaatagcaagaaaggaatacgatattggagacaaataaaaaagaatagaaagtcaaagaatttccaaatgattattttattagattttgtttgatcattaaatttatcctcattttcagaccaaaatagtcacttaaagtttgatgtatttttgtgtatttatttttattgtatatttttggtaaactccatgacatcttttcttttagggaaggtggatgcccagcatgccacatacaagtcaagagagagctttctctttgtgttaccaatttcgataatttaaattttgatttctttaggctgtggagctttgtgtgtctttttttttttttttttggatgcctgcatttttattctgacaatttgtgagtgctttttctaaaataataataattcaaaacaaatagccaaacccctaaaaagtggctttctttttcttttacatctcctgttctccttcagcagacaaaaattcagttagttttgtgaaatgcaacatctagcctcccctgcttttttaaggcaaaaagataaacttcaatggcttgaagctgacagtgtggattcagcttcattcatctacactcaaattgtaaagtattcctcatcctccttttaacctgcatgcatgcagtactgtgtggtaaaagcacaaacccaaactccatcgtcatcttcaattgcataggtcaggcagatttttaggaggaaacacaactgtgaaacctagtctctcttcttgggaaaaaaatcagtcattccactcagcactagctgaaatactgaaaagcaaattgcagcattgcttgggaagagataacttttttttctctcttattgcccttgcctctttctcttgttccctccacctcctcctattcttcttcctcaactaagtaaatcatttatttttctcttttttaagatggctaatataatggtttctctgaagtcagtgtttatgtagctaaccaacggtgctgtcactaacagctgctgctactgtagcaagattttcaatgtggtgtgttttcagtatctgtgcacactgttcctttccaggtttgttgaaagattggaaattcccagtggtaatctcaggtatcatcccggtggccacagatcagccttggttcttcagcttcttcagttatactgctgcccatgaagcaagggttttgttttgttttaaatttctgtcccttagtcaatacttcagtaatcatcagcctagttgttactaatttcagtacatctttctttttttttttttttttggagacagagtcttgctctatcctgaaggctggagtgcagtggtgcgatctcagctcactgcaacctctgcctcccgtgttcaagtgattctcctgcctcagcctcctgagtagctgggattactggtgcctgccactacgcctggctaatttttctatttttggtagagacagggtttcaccatgtgggccaggctggtctagaactcctgacctcaggtgatccaccctccttggcctcccaaagcgctgggatttcaggcgtgagccactgtacccagccgcatctttcttaaatgctgtacataagctccctatcagttcagcacacgactacctatgctttctgtacgattctcaatctagcagtgtggtagaagaaagacatactgtattctactattggttgcatcaggagtatatctgggtatgcattcttctagcctccctttggtccttggacaattatagtctacgcttcccagcaatcttctctttgttcattcagataatccaccatgtcattcatagtctgacttgttcatctgggatttggaggtttgctgaatgccatttgtatgaataccatttaggtatttggtaaactctccaccaataataagggcaatatcaccaaacacagaatctgtgtcttcacaaacctgtggatattctcattccctatgttctccatcaacaaaaggtaagatactgaatttcaaaatgtgacataagtcttccactaaacctatggtctccaataaaacctgacactcagtataatttttcaatacaatatccttgctcagaaagagtttagaggcttctatgtactttagaaattcatcaatcaacatttcccccagtgtgttaactgccattaggtcatcctcttgcattcctccagacctacttgtgatttggaaaatccttgacagggagactatggtctcatcttgatgctgcacttttcagggaacacttcaaagagttaggcagagtaaagaccaaaggtcattgaaatagatcttatcaaaagtgctcttatatgggatttcatctgatacaccttctgcagtcagaccagagctgtcagagtcaatttttgaactgaagggtaatagtacttagtaatatttttcacaatttccatcaaagcatcatatgcagcacttctcaggttgttctgctggtcagcagaagctgtctggggtctccatgagcttctgaaatatgaggataaccaggaagtagcagtgtcttcctggccattacttacaaagtttcataagcagcttcagcgagactgggaaaagcccagcatgcatttgaagacattctgggttcatcattcaggccttccatcagactttgtggcaggggagccaagtagacacccttgatggcagcttcatgaagcagctttcaaaatccgccctcagtgtgtatacttgtatataaaaaaacttacacaagggtctttgattaattccattaagataaacattgcatgtatgactaggagttgtagctttttgggtttctgttcttccaagatacaggcaaaagccgtcacagtagtatcctggtatgactaatcgggatgcttgaatgttctttaacagagagaagtacatgtgggagaatgtcatcttcacatcacgtggtcaggaacatcatcattttcatcactttttgctagtgtctgtataagaattggaaccacaattgtagagctcccttggcacagaactcgctgtgtgctgtgggggccttctttgttctgctgcctcttaagctttaatgacgaaatctattttttcatcacagacactggaccagaattttattccttatagaaccacttcatcaaagtcactattcattacttcatttgtgaccacaaaaagagcaggactcatgtatgtgtccatgtactgataatatagggacattttcttgaccagattctgtaatgtacccacttatacctaattatcttgataataggttgctccgtagacaacctgcaaaataaattgcctttcagactcttcgtcaaagtttgctctggtgaactccagtagttcaggagtgccttagtagccactaacttcacattactattaggacctccaatctctttagatttatcccttagctgctccctgtaaatttcttggcagatgtaataaattgcatccaatgttgacttttccatgtactctaggctgctggggtttgtgacattggctaccagctaaagaatgagttctgacgactagtttactgggatctctgcacaaacagtatcagccatcatagtgaggaagaactaagcccaaagtcctcaaaacagttctcagcttgtttgtcaaacagtagcattaacggcaaccctttctactgatgttgtgccttgaagttaagattcttagatgtcaaagaattcttgatttgtagaccagctacaaccctgcaagtctggctgttttctgaattttctggcactctggagagttccagaaggactcttggtaagttcaaccatcgcacactcaaggaacttctaggcggcttctagttcaagcagaggttgggatgtggttttcaccttggttcagctccaaggtgattttgatagcagcagcttttccccaggaaacacttggcctctcaggcggcagctcttattagggataagggttgggagctgaatggcaatggagaatgtgaagaggatcaaagtcatcacaggttcattcatgtgctccttcttggtagtgctctaccacccttttttccccactctctccctctttccttcctgctttgctgttgacagtggcagctgcccctctgttgaagatgaagcaggaaaattaggggcagctcagagcatggctgtagcttggttggtgaggagagaaagaagacaaggaggcagtgagtgaatagcagtcagaaaggagggagagatttgctaatcttttgattacagaaactaaaagctaaatcatgaataccaggggtcattaaaatgacatacaaatcgcgatagagtgtgcatgaataccaacgctcagttcattgtcttggccaagtgcccaagtaggtgatgatatcttacaaccccaaggatttccttaaaaaaagttacattataaaataacagcctgctgttcacccaaagtttctttatgccaacctatgtgagagaatcaaactttcattattaagtgctttgagattcagacaagtgacaggcactttaaaatctgtttatttggtactaaagaccgtagattagacttttcagccagaattgcacaagtgtgcaacacaaccattagcagtgtcatctgcaatatatggaagtaaaatgattgactggttttaagctaagtcttagactcatctagcatagaccaaaaagacaggggtagtaactatatgcattaaaacgtcatgtaagtacacattcaaatgaaggtcaaagtcacaagggcagaagaactttaggagaaaaaaataaaatcattttagtttgctttcaaattgtcaaaatttagtggctcgccattcctgtatatcagaatggtataactagccaggaacagaaataatccagcagatagggatggatgcaacatagctcaagagcttcatcctggaagcggtagatgatgctggtatagccaagaggtaaaagtcagaaagcaggttctaaaggtactttcttaaggaaacctttgacagattgggaaaaaatagacaggaaatgggttcaggacaatagagctaggaacatgttttacactagacaaaggcaaacagatacacacctaagtttatattttgtggacagaaatgacttataaggtttgtgctgggaagcagagaggagcagagactttacaacaaagctgtccaatttgtgtttgtagctaatggtagcagagaatttagggttacttacgatcttagacatgcaaattgtgtttcctagccttagcaggaaagtctgtggagctggtgagtacttttcataaagtagtggatctgggctgggtgcggtggctcatgcctataatcccagcactttgggaggccaaggtgggtggatcacctgaggtcaggggttcgagaccaacctggccaacatggtgaaaccccgtctctactaaaaatacaaaaattagctgggcatggtggtgcatgcctgtaatcccagctactcgtaaagctgaggcaggagaatcgcttgaacttaggaggcagaggttgcagtgagccgaaatcacactaccgcactctagcctgggtgacagaatgagactctatctcaaaaaaaaaaagaaaaaaaaaatcagtggatctgatctatgctgtctgctccctaattttagagaatgttcaaatatctacccctggaaagtcacaaactaaatatgaaatgtgcagtattaatctggaagtattaataactgcattacctttctaatacttattttctgaaacctactttaaaattctgaaataaaatttatagatactataacctactgtcacacactattcaaggggaaaaaggaacaatataatgttctatcaataatataaaaggtaaatgaaaagaaagtaacatatagctaaatatacaaatggtcagtcaaaactacttcagaagatgtaataaaatagatgcttataactacaggtaaaaatcattatgacatgacagctaccaaggtttactttgtaggtgccaaatacctaaatacccaaataccataagtgtaattgctgtttatgacatgatttcctctaaatgattaaaaagggaaaaaaagcttattaagtttcaaaccaaacaaagaataatatttcctcaaattatagtgtaaaaaaattttcaactgcatgaatgtgtgtttggacatttgaaagtgatttaacaaatatttattgagcactcattaagtgccaagcactgtcttagatacttggaatagaacagtgaacaagacaggcaagtatccctgccctcagggagcttacagactagttgggagtggagtgggaagaagacagacaataaacacagaaaaccaaaaccaattgaatagcatattgaaaggtattaagtgtcttgggagaaaatagagcagggtaactattggaattgccaaggagtggtaggtggttcgaatttgaaatgagagtggttttgacaggcctcattgagaaggtgatatctgcagaaaatcttgaaagagctgaagaagttaaccatgaattctaggcagagagaacagccagtgcgaaggctgtaatgagggctcatgcctggcgaaggtggagcaagggagccagtctagccaaaatcaagtgtatgaagtgggcagtagcagggcatgaggtcagagaggtagtgggaggcaggatgatcttgtaggactttgtagaccactttaggcacttaaaatttcattctgaatgggaagccattgcagagttttaagcagaggagtgacatgatatcttatttatgatttaaatagatgctatgttgggaatagttgggggtggggttggggctggacaaggatggaatcagggagtctagttgggaggatattgtagtccaggtaagaaatgactgtggctagatcagggttttatcactggagatggtgagaaatagctgagttttgtataagttttaaagagccaacagaatttcctgatgaattggatggagtatgagagaaagagcgtgatggaaaatgatttccaaatttttagcctgaaaaagattccggatggtgaaagttcctatttactgagatgggaaaacttgcagcttttgtggggtgaaagaagaggaatatcaaattcagttttgaagatgtcaagtttgaaatgtttattagacatctaagtggagatgttgggtaggcagttggaaatacaagtatgatattcagaagaaagttctgaactaaagttaaaaacttggtaggcttagctatatctctggtatttaaagctatttattgggtaagctcaccattaatgggggtaaaaatgggacctgcacatttggcactgtagccagtttccccagaaggcattttcaactccatcaacaggggtcaagggaaatccacacaaatcttcaaatgtaattattctcctccttcaaaaggaattaataggccttgtgcactgggaatcagatctcaccttttcttgacttctaccccaccattagagtaaaacaaggagcctgagtactgggaatgatgttcagctcctccaggtgttcttaacaccatcaaaaagtcaagagtgagaccccatactggggcaaagaccctgcttcctctagacgttttaccctccataatcaggaatcaaggtgggatttgagcactgcaaataacacctggctttccctgtaattatcgactccatagacattgtcattcactagtccttgtcatttctaatgacttcaatttttccataatctcaatttcattataatcactcatctgcatactcccacacctcccatgtcatgaaacagttattttgaatttctagatggggaaatttgccacttactgagaagtggtgtatcaagttcaatgcaggagtgtcttgtatgttttcaggaaatctataatctctggtctctgttcactaaatgtcagtagggtcctccaatcattatgacaacaaaaattcccccatatactattaaatgtcccatggggaagccacaccttccttgttgagaattgcggctctattttacacaaaatatcatcgattctaaaatgttgagtgaaacagcatgtactcactcagagtatcattaaaattttcagaattttcccttctggctagcaagatctataaagatagacccgtttttatatttcaattttgacagttctctcaaataacctataaaatcaccaccaattattttcagatttagttattctgtctttaaaatgggaatagcattttccagagcaccacttacgtactgatgctggaaagatgaggacagtatataatatgcctgaacttttcagaatataagacgttacctaactcctattaataattatttttaagacaaagctgaaaaatatactggatatagaaaataaagaagatgtgcagatgacgacattattaagcttataaaaatctgttttcctatataaagaacagttctactgcaggaataaataccttccagtgtcattgagaagtaaaatatggccataatacatattggcaatttaagagactatagaggattaaaggggatttgccacaagttgctgagtgattttgaccagatttaggtaagcattttgcaaaatgcatagctcttcaactaattctaagtgcttaaagaaacagaatttacatcctcttgaatccaaagtgtcatcatcatcaccatcttaatatttattgagtgcccactgggcgcctaatactatgctaatttttcaagtcagtattttcgtagtctttgtggattgtaatctcatggctgagacatccacttagaaatttaaaagaataatttctctgtggtatcatgaaaggtagcagaattttggctttatagtaagaagttttaaataggtataatgaaaggacccctgggcacagatctcctgccatccaactaagaaacctccctatgggatgtctggttgaatgaactcctggtccttagaatcagacaaagatctctatgatcattaaattagattgacagacactgccttgagacaatggcaggggttcttactgagcacctgcagatcacgatgtagttagaagtgaatacccttatacatggatatcatttccaaaacttgacactgtatttgcataacgtatatgtgtagtaaatttaaaaaactgaaaactataattcagttgtaaaatatccaccccacaatccagctccaaaacattatctgtgctatctctaggactgggtactgcagaataaggttatttctgaacagcttcagagtcagacggttatataagctgcaccccaacattctggcttcaatttcagtgcattttgaaaggccaaatgcaaagtctgactgctggcaagtcttaatacttctgccagtaaatgatgctgaatctttcaaacagcaaagtgttattttgatctcttttcactgcctctcagttcttccctggcctctggcagtaaaagataatcacttctgggagcaattaatttcacctagagcttttctttaaattcactgtatttgttatgacaagatgtgcaactcaaaataataaaatgaacgaaagccttgatttacatgttaggtgagctggagttagattgaatagatattaagagtaccattatttctgatctgagggagacacccttttgcacagtggccagttgttaatcttctgggtgtctctgggttctgggtagcacagctacctgagctatgtcttttgaatacagagttacttcctttccaaaacatgtcatgccattcttgaagggtcttcagccgttcctttcctttatgaaggagttggattgcaatggctttttgccttcttcgccatgacctgaaaaagcatgcacacctggtggaaacttcttcagtaacagccaaacatgttggcttcaatttctgtcttctgcgatgcaaatgattcatttcctgtgttgctaatgtgtgtctttagatgaaaacctttctccctttcaaatgtaaaatctctctgaagagtttatttaagttaccttatcctggagccccacacttgcccgtagttacattattcatgatgcagagagctgcccagacaatgagctgttgggtgagtactcggagtgctttggagatgatccacactcctgaagtattgtttgagtaaaagcagtgtctgagttctcttactgattagtagacacacttataaaactgtgatcattctgtatctgaaattttcaaaaaagggctaaaccttctaactcattttcagtgaggaaggaattcgcttctaaaacaggacactattagaatgtgggatgcagaataaaagtgggttaaggatgagggagctagtaagattgaaaatggtatgacattcttgaatgaaatatgtgataaagccagatattctagttaagccgacagagtgtcagataaatgaagcaaaatgaaacctggcaacattacgaatatcttttcaacatttcagtgtgagaagagacgtgtctaagtacaagtatagcattctttcatagttttgcatgtggcagatatgctggtgttatccttaaaaaatcattaatagttttccaacaattgggaagaaggcctttttttaaaattagacatcttaacacttagtgatttcctgcactaatggttacacaggtttttctactttatatggtccctaaaatattcaacataaaaaatgatacgtctagccaagcgagagaaataaagcctcatccagccagctagccagccagcaagctatttcacaagtatgcatttcatctacctgctgtgtgttaaacactataaaaaatacaaaggtgaatcaatcattgattccacactcaagaaacttaaatagaggcaatagaatgtgtagattaatcaaaagcaatgagaccactagttaaattttatactaatttgtaacccacaactatctagaaaggcattgtgaggccttataacatggacaataggagagtaaatagaaaatataaaccaaggaaaaagggtaaatgtatgcatgctaattttaaaaataaatagaatttttgtaattgagttgaaatggtggctctgagcttcctggaaccccaaacaaaataagttactaagttatgtaaagggcccatatcaaacccatatcagttcctaagcggaggcaagtttttaaatagctcaactctatcatgtagttcattgcacaggacaatgaaaaatgaacacttttaaaagtaaatgcagaatattctgtaagatttcttataaaagcagagagggtaatatacaaagatagcgccgtgaagggaattctaggaaagactaagttaaagtggttaaagcatatacttttctgtggcctcaataataaaatatagaacttatagcagtgaattcaagatactgctctataggttggtgactttctgtggttcggtttttattggtacatggcaaatgggaaaaatgagtgtatactaagttttaacagagctcaatttgtttaatttaatggtctcttttattctaagattatttcctcctattttttgatataaagatgtcttttgttctgagaaacaatgttgacaatagaaggttatttactaaaatgcagtaacttgatgaaatacagagttatcaaccaaatgttggtcttctcacctttagtttgtttgtgttttgtttgaatttgaaggactgttaaacacaagtgtagaaaccacacctgaaagtgttcaaataaatgaggactacatacttgtctgcccttgccaacctaagtcatgtctactggcagaaataaactgctaacaatggtctcagcctcatccaaagtatgataagattagactcaggctgagggtgtatattggaaacacctccactggtaagtggaattgaaaaagtctgtttacctttcagcgagtgatgagtttcaggctgtaacattttttccagtcgtcatcatgtgttgtcagtctattaacctgcatattttcctagcccttgattcacactggggctggaattgtccctgaacatcatctcagaggtctattctccttcatgagaagcagattcatagttatcctccacaaacctacatctactgcattccaagtattgattcaaaaatgtaacacaaacaatgaaatataaaaagatcacctattttttaaaaagtaaagtagaagatataaaataaatttaaaataaaggaattaaaaataaaaatgaaaagaaataataaaatatgggaataaaaatataaagataataaaactggcaacatgcttgcaatagaacaattttctaattgagatcattaaatgaaacaaaaaggaatttaacatataaagaataatgtagtaaaatagtgaaaacaataagaacaaaggaacagataacaaaacaattaaaatgtattagaattcattaatgaaaaggcactacattaatgataagaaactgatagaaaagagaaaaataacaattccaacaaaataaaaaagatgacttaaaaaatttacttaaaagacaatgacttgaggagaaactgcattaaaaaaaaactaactcatgtattccagacttcattaacttgtaactgaaaaacaaacaaaaatcctttctctactcaaattattatgcgaagaacctctcattccccacttttcagcttcaaaataacaggctcaatatattgtctcatgtgtgcttataatgaatacttccagaatttctgttgtgtgcttcatgtcttgacactatagggcttcctctttagccaataactctcataaaattgctgttctcttaaactgttgcattaggagtaactatcacatttattcctccccaccagtccccaggaaggatacagctctctccttggataagaattccttcctcatagggttgctgatgggagtcaatgagaaaaatgcatgtaaagcacttaaaaaggggtgggcacataataagggctccataaatggtagtgacagttacagctgcccctggtcttctagcatggcccttatggtagatggtattattggtcccaatcattcactcccttcataggaggataatgcattgcaactcatggccatgggacttgcagtatttccatgtagaggagtatattctctgcctcatttattatatttgaagtttggccatgtgactttctccagccaatgaaatatgagtgaaatgatatgcactgtatctgagttgaagctttcagagaagaaaataggggctactcctttagcttagatctcataatgaaaaggcacaggttgcggaactagagctgactcacagtcactgatgggactatgagggagaaaaaatattggttgtggttaagccagtgagattatttttaaccttagtataactgcaaacaagctgactgacacagcctcatatcttcatttgctgtaatattccactccctgaatgttcatcctacattttaattcttgttttgctcttccttcttacatcttgttcctcttagactatggcttttaaactgttacttgtttaactttacgttttcctaagtttggaatacttagtactgttgggacacaggcacataatagatgatttataatgagaacgttaatctcttttcaatgctcattcagttcttctgattacattaatgagaaattcttggtttggtgctggtttgtcattaataactctataacagttgccaatacttctttgaaaaaagacaaaagtggtcttcaagctaagagaataggactaacaatagtatctagctggaacttaataatattgtttaatccacattgtatttattgtatggtcaccctttgttaataacaagtgttatcgatctgccagttacaatatagctcccttttaaaattagtacatttatttaagtaatgaaatgagctgatttagataaagtttcaagtgatgaaatttggaagactctgacccatcttaaggcctcaccttctttagcaatggaaatgaacctgtctcaatctgtacgtcttatagggtttgcttacttccatgtccacttcaggcccggctcttagatttacccctttgacctcctgcccagtacaagtttctgggcctgaaacctgaaaatgtaacttctctttctaatttttaaatttcactgaaaagacaaattcattgcatcttgtatgcatcttcctgtagacttaaatagtttcaaagaacatactgctctaattttgtttctgcttctagtacgtacacagcaactaaacaccaccaggaccgtttttactgtgacctcttctcagcttcagtaaacagtccactactcaaagctgagtcttgatcccaagagtaaaagggatccattgcttctagtaatagcatttcctttccccttattaatgcccccaataatcttaaggctttagggaatcaactgctacacaacagctaacttgattgagctatttactataactcatggttgttttcctcagagacagcttcaaatatagaatcctattaatgtttatcagaaagctgtttttcctataatatgtttttttcttatttaatataaacatttttgttgtagcatgttgctcagtttcccaagacaattaagtttgtttgaaatgaatctgtgttgtgccccgccccttacaaagtaataaaataaagattccctttgtgctagttaatgtgctgagccactgtcaggggctgacacagcctcaggagtgggcattatgagaagtgcttgaccaaaggctactgaagagcttggaaacaggcagcaaccagttagatgcagaaagcctgaaagtgaggttgcactgaagtcttgctctttctattgctactaatagtatcatcagagttgcctccatttgatgagattgctccacagacaccataagaaagagccaaagaatagcttttgtattactagcactctccagctgccagcagcaactacagcttaacaaccctattgccctatacttgtgtgacatggacagcaaaagtgtgtacatgacatgctctggagctctggtgaatactattgcttttctcatccagatttgcctctagtcaattaattaagcaccttgtgcttgtgctttcctagtttagcacttacatgtttaactttttcaaaatactttactcacaaataataataataataatgctacaatttcttgagcaccaactatgctcccaggcattttacatattcattcagtcaataattactgagtcattaccatgcattatgcattttcctgatcattggagtgacattattaaatgatataaacaagatatttgctcttctggaaataagaacctactaggggagataaagagtaaacacacaataataatcaacaaacttgatacattgtatagataatataaagttagtgcattagtgtgttctcatgctgctataaagaactgcccaagatggggtaatttataaaggaaagaggtttaattgactcacagttccacatgactggggagacctcaagaaacttacaatcatggtggaaggggaagcaaacatgtccttcttcacatggtggcaggaaggagaagaatgagaactgagtgaaggggaaaacctcttataaaaccaccactcccatgattcaattacctcccactgggtccctctcatgacatgtgggattatgggaactacaattcaagatgagatttgggtggagacacagacaaaccatatcattcagtccctggcccctcccaaatctcatatcctcacatttcaaaacacagtcatgcctttccaacagtccctcaaaatcttagctaattccagcatcaacccaaaagttcaagtccaaagtcttatctaagacaaggcaagtcccttccacctataagcatttaaaatcaaaagcaaataacttacttcctagatacaatgggggtacaggtattgggtaaatacacccattccaagtggaaggaattggccaaaacgaaggggctacagaccccatgcgagtccaaaatccagcagggcagtcaaatcttaaagctccaaaatgatctcctttgactccgtgtctcacatccaggtcatgctgatgtaagaggtggatttccatagccttgggcaactctgcccctgtggctttgcagggtacagcctccctcccagctgctttcatggactggtattgagtgtctgtggcttttccaggtgtatggtgtaagctgttggtagatccagcattctggggtctggaggactgtggccctcttctcacagcttcactaggcaataccccagtggggattctgtgtgggggctctgaccccacattttctttctgcactgccctagcagaggttctccatgagtgttccaccactgcagcaaacttctgcctggacatatgggtgtttccatatatccactgaaatctaggtggcggctcccaaacctaaattcttgacttctatgcacccgcaggcccaacaccatgtggaagctgccaactcttggggcttgcaccctctgaagcaatggtctgagctgtatgtttgccccttttagccacaactgggatggagtgcaccaagtcttgagactgcacaatgcagcaaggtgctggtcctggcccaggaaaccattttctcctcttaggtctcctggcttgtaatgggaggggctgctgtgaagacctctgacatgccctggatacattttccccattttcttggtgattaacatttggctcctcactacttaggcaaatttccgcagcaggcttgaatttctcctcagaaaatgggtttttcttttcttttgcatcattgggctgcaaattttccaaacttttgtgctctgcttcccttttaaacataagttcccattccaaaccatatctttgtgtatacataaaactgaatgcttttaacagcacctaagttacatcttgaatactttgctacttggaaatttcttctgccagataccctaagtcatctctctcaagttcaaagttccacagatctctagggcagaagcaaaatgcctccagtcgctttgctaaaatatagcaagagtcacctttattccacttcccaacaagttccccatctccatctgagaccacctcagcttggacttcattgtccgtatcactatcagcattttggtcaaaaccatttaacaagtctctaggaaattccaaactttcccacatgttcctgtcttccaagccctccaactctctaggaagttccaaacttttccgacattttccagtcttcttctgaggcctccaaactgtcccaacctctgccttttaccctgttccagtctcttcaatatttttgggtatcccgacagcagtgccctgctctctgtggtagcaatttactgtattggtctgttctcacactgctataaagaattgcctgagactgggtaatttataaaggaaagagatttaattaaccaacagttctgcataactggggaggcctcaggaaacttacaatcatggcaggaggggaagcaaacatgcccttcttcacatgatggcaggagggagaagaatgagaactgagtgtagggggaagccccttacaaaaccgtcacccccaggattcagttacctcccactgggtccttcccacagcttgtagggattatggcaactacaattcaagatgagatttgggtggggacacagccaaaccatatcagtaagaaataggaaaatgcaaaatgtgattgtagacaatgttaatttatagagggtagtcagggaaggcctctctgataaggtgacatttgagcaaagaccttaagtgagagttctccctctaactttcaaacttcattccctatcacttttctctcaccatatcccagaacaatgtgttttagaaatactgacctccttgctgttccttgagtacaaccttgctgtctcctctgcctagaatgttctcccctatttatttacatagttccttcactcaccccgttcagaaacgtgaaatcaatcaaaataggttgctggtttattgtggaaattgaggaagtgggaacaataaaggacaacacccacattttgggctggagcaactgggtataaatgtaaagaacacagaatgggaaggatctggttttattagaaaaataataaactcatcatgaacagtcaaatacacatgtctgacaggaaagagatctgggttgataatatatactatttggtttttgaataaataaacaagttataaattttggagtcaacagctcacaggtggtaatggtcaactataagagtgagtgagatcacacagggagagtatgcataatgacaagagaagagggcttagtccagagtaatgaaaaacagcaacctttaatgcctggataggggaggatcagctcttgaagaatactgggaaagaataaccttagggaggtaaatagaaattaaggataacacagagacttagaagccaggggatagcgatctttcaattaggggatggagaagagtgagaaatgctaccaagaagtcaaacaaggtgagtactgggaatccactggacttatcaatgaagaaatagatgataaatgaagagcagttttaatttggcgatagctatggaagacagattgctgtgggatgaaaggtgagtgagagcacagggattagaaaaatgtgaatttaggcaactccttaaagatatttggatataaagtggtagtgagagataaaactttatctcatttgattctcataacctggtaattcagacatttatatttttctccactgtatagttgagtctcagagtggttaaaaacttttccaagatcaaatatttagtaaacgttaggagcaaaatgttaagctgagtcttctctctccaaagtttcttcttctctagtccctatcctcagttacttgacctgctagaatcaagcagagcaggaaagttccattcttacccacaaactgaataaaggagcccagtaggggattaacacccaagttaataagttgcaaactttttcaggaagaaagcacaaaagtgattataacaaagctaacaacttatattctttggttcttccatttgattaatagatatgtagtaaatggaccgcagcaataaaacagaaagtgctacctcctttctggagttgctgtaaatattcctcagatgtcaaaaaaagtagaaaaattcttgttacaattaattttggtaatggaatgtatataaagatacatacctcaacttggctttttggtcagcaccaagatgcactatttcttgcggtaaatatcgatctaagataagatcaatatttacctcacagttcaatatgttgtgtgactgtcttcaacacaagtcaatatctgcgtaatgtctgcaacctgcttcttatcagtgcttttgaaacttccctatagccctcaggatgtttggaaatttgaagtgttctggattcttgtcggctctttacagtcaatctatacacagtagagctatataatatgactctttctagcatagttgtgattgctagacaaacagttcctgaaactcctagaagccagaccttctaggatgtagaataagcctagatgtgcccaatcctggactctattctattgagatcccttcatatagtacacaatatgaattactaaatggcaaattgccatgcgtaaaacccacaactttgactgaggtcatgattatgtcattcaaattacattaatcttacctttttatcctttggaacagacctgctagaatcaagcagatcaggaaagttctattcttacccacaaaatggaataggggagcccagtaggggattaacacccaaggttagaattcacttccattgtatccaacattagtcaaaacatttttaaagtattatgaagagtgaatttttagactgtgaaaagaatagaaagatacaggagagtacaaaaaagtataataaagaatttcaaaggagtggaaaataagctctgcaagaaaaggttcaaggcatgaaaagtgtgatcttaaaatatctaaggggattatatgttgagaccactgagtttttctgtttgttagtagaaaactgagtaggagaaaattgtattaaattgaaataaggagtagtgtttagagagtgcttagaccagaaatagatttgagagttttggggcatcagtataatagttataatcatgattttgggtaagatttaaaaagtagtatgagagaagtacaagaattaactggagaaacacaaaaaaaataggaattgagaggaggaattaaagtcagtaggttcaaaaatggaggaaggaaacaggacaatggaatatcatcaaaggaggaagtttttattgagcacttagtgtgtgccaggcacttttcaaagtacttaccatatattatctcatttaatcctaacaaccgtatgattttggttctgtggtaatagaatcccctctgttttacagacaatcaagctgaggcttggagaagttcactgactttctcctgtcacagccctctgaaatggaagtcaggatttgatccaggcagaccgggtccagtgcctacattttagcatctttgcactgcctctaaatataaagtttccagtggtagaagagtaggcaaatgtcacatactggaaagagggccaagaggatgaggactgataaaaatatttggtgattgagagatgaaagataacattagaaagagcaagtctcagtagaacagaaaagaaagaagctaagcattcagggaatgtgttatcagggagtggagcaacaaacacagattgccattgaatggaaaagggaagatacaatagtaacgtgagaaagtggcaggaaaaagtatactactacttattttaaagacagaggagacttgaatatgtttttgtttatctttgagtaaatgatagtattaccattaatatactttacttagaaaaccaaggtcacatgacatgtgttccttcaacttgtttctcttctaaaaatatgtttgtacctgtgtgcaattatgatgagtctgctttcacaactcacttcctcactatccaccagcctagaatcagaaagagagaaaaaaagattatgtggtttcttcacaactggggataataagagaagtttacaaggacaaagtcacattgtcaccgacttctgtgacagagttattgtatttatgagcaatttaaaactgacacaagggccgggcgcagtggctcacgcctgtaatcccagcattttgggaggctgaggcaggtggatcacgacatcaggagtcaggagatcgagaccattctagctaacacggtgaaatcccgtctctactaaaaatacaaaaactagccgggcatgttggcgggcgcctgtagtcccagctacttgggaggctgaggcaggagaatggcgtgaatccgagaggcggagcttgcagtgagccgagattgtgccactgcactccagcctgggcaacagagccagactctgactcaaaaaaaaaaaaaaaaaacaaaaaaccaaaaaaaagctaacacatggtgtaaacttcactctattgattcaatcaagtggctatttttttttttttttattatttgatgactctatatgcttacaattttatgtatgggtttactgtggatctgccattatcatctctgtatccgttggcagacctcatttcaattgtaaacttccaaacaatatgcataagaaatgatgtattggaacaaccacatgaactttggcattaactctgcaacctattccctctatgacttggaaaagtcacttaacctctttttgatcccatttcatacttgtaatatgaggaaaataatgctaactattttgtggagatgtgttgaggattaagtcagatagtgtacagttcagattctattaatggtccaactctttacccttttctaaatccaggccctttgcctggttactttgcatcttcttctactaaagatgcagagtattatttccccaacccttgactttaagtttagccttgtagcttgcttcagtcaatggcatgctgtaggacataatgtgacaaaaatatgtcaagctcttattccattcagctttctgtcttcttcctttaccatcaacttaaaacaaatattcttgctggttctggaagaagagacactggggcagaacaaaccaccttatctgggcccagcctagatcagacaactcctagacaacctccagatccatgagcaaagccagattgagatgagaaaaactgcaagctgtgcccaacttcgatcatcgaatgcctaactgacccacagacacatgagagtaaatgattgctattttggggatgatttcacagcatttttttttttttttttttgagacaaagtctcgctctgtcacccagactggagtgcagtggcgtgatctcggctcactgcaagctccgcctcccaggttcacgacattctcctgcctcagcctccctagtagctgggactataggtgcctgccaccacgcctggctaattttttgtatttttagtagagacggggtttcaccgtgttagccaggatggtctcgatctcctgacctcgtgatccgcccacctcggcctcccaaagtgctgggattacaggcgtgagccaccgcgcccggccacacagcatattttcgtggtgataactatacttgtcagggacttagcgcagtgcttggcacatgattgtttttaacaaattgtctttaacaaatcttaattgctttttttttggtatggataaaatgcaatacatattttatacagtttacctatagtataaaacatgcagctattaagaaatatttggatgaatgaatgtttccatttggtgtcatgcagacatcacttttgcaatatgcagtgaaatagcaaatctttcacaaagaattctcttagagttttgcatgttgattgctgtattcttctcatgcaagtgtaacttcctcccactaatgctaatatgaattatgtgtgtgcactgaaaggaaaatatattccatgaatattacactaatgaattaatttagaaactcagactcatctatttattaactcccgactcatcaccttatgtattttgcatgttgtagtaaatgcagaaagaaacatttagaaatattcacttgcttttccatagggatcagctcagggaataaatctgagttttataatgctgtcttaatattacatgcatactgaggaagattcttaaagattatcttgactgctcattttctgttataattatctaaacctgtaaatttcaatttattgtcttcaaagtttctttgattaatgtaatcatatacctccacttctcagatgtttcttaacatcttcattgatattgttaactacttgtcatattctactaaaatttattatttctttgttgatgtttagtgtattaaatacaagtaattgacacccttcctaaaaagtctgcataccggccgggcgcggtggctcacacctgtaatcccagcactttgggaggccgaggcgggcggatcacgaggtcagaagatcgagaccatcctggctaacacggcgaaacactgcctctactaaaaatacaaaatattagccaggcgtggtggcggacacctgtagtcccagctactcaggaggctgaggcaggagaatggcgtgaacccgggaggcggagcttgcagtgagccgagattgtgccactgcactccagcctgggtgacagagtgatactctgtctcggaaaaaaaaaaaaaaaagtctgcatacctccttaatcatcaatagcttgtgatataaatcttcagaacatacgtggctttactagtaaccagattccatttgtaattttttttttttttttttttttttttttttttgagacagagttttgctcttgttgcccaggctggagtgcaatggtggggtctcagctcacagcaacctccacctcctgggttcaagcgattctcctgcctcagcctcctgagtagctgggattataggcacgtgccaccatgcccggctaatttttgtatgtttagtggagacggggtttcatcttattggccaggctggtctccaactcctgacctcaggtgatcctcctgccttggcctcccaaagtgctgggtttacaggcctgagccactgcacctggcctctatttggaattttgtatttagaggagatggagaggtagaggttgatggtaggttatgtagcaagggacaggataattgcctggtctttataaattgttatctgcacaaaaccatcacatactacttaaatctgtaacttgatttttgcacccataattaaaggcgtgttaccatggaataaatcctttctaaaggcttttaacgcatatatggtactatatgtaatatgtgaaaggaggtaaagtttgagcaaactagggaaaatttttcacctgtttgaggacaatttagaaataattcaaagatgttaaatagacattagatgtgggagactagatgttggagaaaaaaaaaattagaagctacaaacttatatccacctgctgtatgctaacactcaagcatttatatttctatttattcaaattacatgtaagtttagtttaattcagatggtgtttatgcatcagatccacttctcttccatcaactgcaagcctttgctccatcaattattccctcttacatctgtattctcgaactctttgggtccttccactagaggtataactatgatcaaatattcccctttcaaaataccttcctttgagcctattgacattggtttgtcactctagagacttctctcctttacttcacatgcaggagtttatgaagaatatttttcacagctgtctttcacttcatcatcttcaatttaacccacatggatctagcttccattcccatcatattgctgaaacatctctgaaagaagtaattaatgacttctaaatcggcaatttcaatttcaatccctttctcacttgaccattttacaatattgctggacatgcactacatcttgaaaatctttcactggtttctgtgattaccctttcttagttctcttttgagtatttttttttggagacggagtcttgctgtgtcccccaggctggagtgcaatggtatgatattggttcactgcaagctccgcctcctgggttcacgacattctcctgcctcagcctcccaagtagctgggattacaggcactcgccaccacgcccggctaatttttttgtatttttagtagagacggggtttcaccatgttagccaggatggtctcgatctcctgacctcatgatccgcctgcctcggccttccaaagtgctgggattacaggcgtgagccaccacaccccgccttgagtatttctttttgttctcctttgttggcttttctcccttcaatgctcctttaatattggtactttccagtactaaaatatttaactcttttttttttcactctacacattgttctcgtttttgactattttttcttggcttcaactatcatctgtattctaacaactggcaatagcttaagtccagatttctattttaaattcactagcagaaattttctcttggacatcttatagccaactcagagaaatttactaaaaaaggatcttactttttccaaagcattttcttctccctatgcttcctatcttggtaaatggcagcattaatcattcatttatccaagacagaaacctgatagactccttctactcttccatttgcattatcataaacatttcaattactatagatttatatatatgtttctcaaatctcttcttacactcatcattttaatttgtgtttttatgacctctatcccacaaaatttcagtagtttcctcatttgttttaaaacttttggatttcagatacaagcacattaattagtgagtttatcaaggtcacctggaaaaagtcaagattgagaaatatttctatttctgtaaaatgataagaaattttgcaaataaaattaaaaatgtcatttaacatagcaagaaaaatcatcaagtacttagaattaaatctaatgaaagatatgacaaaccattatacctgaaacaacaaaacatttctgagagacattgaaaaagatttaaataaacagaaaaacatagcatggttatggattgatcggaggacacaatagtgttatgatgtcgattcgtccaaaattgatctataaagtaaaggcattctcagtcaaatcactgcagtgtgtgtgagtgtatgtgtgtgtgtataaactgacaagctgattataagatttgaattgaaatgcaaaagtattgaatagtcaatacagtgttgaaagagaggaaacaaagttggaggtcttatgctcctggacttcaagactacttataaacccataatggttaaagcagtgtagtactgatgaaaggattgacaaatagaccaacagtacagaaaagagagtccagaaacaggcccacatatatagagtcacttgacttataactaagatttcactgtaattaagtgggggaaagaataattttattaaataaataatgtcagagtaattgaatttttatatgaaagaaaatggaccttgataccgatgtcaaactatacacaaaaataaaatttaaatggaccgtggacctaaatgtgaaaaatgaaacaatgggcacttttagatcagactatggctcttaggccaaatccagacttctgcctctttttgtaaataaaattttaacagaacacaaccagcccattcatttgtgtattgttatgattgctttcatgctacaatggcagagttgagtagttatgaaagagactacatggcctgcaaagccatatgtatttactatccagtattttacagaaaaaaattgtcaaactctgttctagaagaaaacaggagtatacctttatgactatggagtggtattttaaaaattttatataaggaaaaaacccataaaacaagaccatataagattaactaaagaaataaatttgactccattaagttaagaacacctttttatcaggattggtgtctagactgtaacaaaaactcttaggtatcattaagaaaaaaagacaagttatccaatttaaaaatgaacaaaggatttgaatgcatacttctccacagaaggatacacaagtggctgataatcatatgtaaagatgctcaatatcgttagtcaagaacataaacaaaaccacaacgtgatatccatttgatatccattaggatggctctaattaaaaagacagaaaataacaagtgtaggcaaatatgtggagaaattagactcttaatacaccgccggtaggaatgtaaactggtctgtgcattctctttggaaaacaacttggctgttcctcaaaaagttaaacaaatagttaccacatgatccagcaatttcacttctagatataaatccaagaaaatagaaaaatatgcccacagaaaaactcatacatgaatgtttataatagcattattcataatagtgaaaaagcagaaaccacgcaaatatccaccagttgatggatggataaccaaaatgtggtatattcatacaatggaatactatttagccagaaaaagaaaagaagtactgtagatgctacaacatggatgaaacttgaaaatattatgctaacttaaagaagccagatgcaaaaggcagcatattgtatgattccatttatatgaaatgtccagaatagtcaaatccatagagacccaaagtagtagattaatggttgccaggagttggagtcccaggagaatggggaatgactgctaatgagcatggggtttcttttttgcaggaggaaaatattctggaattatgtagtgttgatagttgtataactttatgaatattttaaaaatcactcaattgcatactttaaaaggatgaaaattatagcatgtgaattatagcccataaaagttaccaaaactatgtaatcatggttacatgtaagaaattgaagttatactaatccatggatcagctaaatagataaaataaagtaaaaaacagtaattttgtttagatgacccaacatacacgtacaaaaaacccgcaatgaaatatcaccatacactcaccaaaatggtaaaaattcaaaatacctaatagcaactgttggcaagcatgtagaataattgaagctttcatatattggtgatggaagtgtaattttatgcagcaactctgaataaatttagttgatactgtttggcatcttcttaacatatgctaaatatattacagaagcttatattagaaaaagttaaatatatggttatcctatgacccagaaattctacttccacatatatagccaagagaaatgagtggatatgttcacaaaaagactcataaaataatggtcattttgcttggtacaagtggaaaccttgtttcagattagcaacagttgaggacttacatcttggtattattgttctactagtatctcagccttcaatctttcacttcttcaatctaaacaaaatagttttgtttccttacattttcattcattgttctgcttaaaatccttcaatggctcccaactgtataaagcagtggctttccactctggctgcagttagaataaccagggagcttttaaaaatggcctttactcatcatagctcaataaatcagaatcttgggagggtggtgttcgggtacaggcatttgtttcttaactctacactttacagtatcatgcaccaagaagaaacacacactcaattacttagtatctgaacggtttctccatgctgctatgttgctccctcttgtcttatctttcttgggagctattagccttcgtacaagactcagtttaaatataatctcttcgtgaagccaccacctatttccactgtccccaagcagagttagattcttcatagccacctcctatagcatctatcacttactattgtaattataacagagcaagagtttcatcaggcaggtcctgcactttatttatatttttatctctagtgtctagtagagtgtacaggacaacgttcaataaaacttgaatgaatgaataaatgaatctctaattgtgagactttgcaggaataagtcccctgattgcctgcagttaatttaatagaactggctatctcctaaaaaagaatttatgtactgaaaacgtgtgggaaaatacaaaaatagaaatcaacatgggttaagaagttcattcaagcaaggtaaagttcaatgaaacatacatagaataatccttcaaaaatattacatgcaattgtgtaaaaactacttgcagcaaatatggtattcttggtgaaagtagggaaagcaacgatagatactgcatacatcaaaagtattatgttgacatcaatgagagcttcttagacaaagctgactcctgtgtgaaggaagcctgtggaaagataattctgaaaattttacatcccttgagaatgatttctgaacatcacttttgaacaaaaaattgtgtaaaaattgaaggacaaaaatcagacatagtttctttttacaatttctccattttccccactgcaggatggattgcagcaaaaggagatgaagtaaatgggcagtctacgtaggatgaaaatggagtgtgcttctttttctaagcccagcaactcaggatcctttactgatttgtagaatgattataagcactgccacaatcaaatctagcagaaggtaattctaacagagtcttttgaagagatgatcttaacaaatatttacctcatcatttggtcatttgatggaaacaaaacagaatcatttcactcattctaatctggtgccgaattatcaaggtaaggagacaacctaaactttaatgcttcctttggcagtatatgcagtcatagaataaattctctaaatccaaagcaatactctagcactatagattcctttaaaattcttaatcgtacatagcattgctaaatttccttacttatactgtgtaagaatatgccctgcgcttttttgtcactggcaatgctttaagaaaacttgtgaaaggatttagtatcctgctttgaagctttaacacaaacttggggactgtgaggattactgctgctgctgatggcaagactagaaaagtatcatatttgtctccttgtcctcactgactctctggtaaaatttttcaggcttattttttattcttccctttgtctttcatttttttccaccttattgttcctgggtatgggctcttgcaaggctctgtgagacccactccattttattctggaaaacacaaagaataaggtgaattgttcattaatctgcagcactttcacaatcacaactccagctttccagttttattgggcaccatatagccactgtgctgttttgataggaggcatattgagtatactggtttgacccagaatattattgccacagctctctgacagggattcgtattgcactatctctccttgtcatttccaaagcaacttttgccacatgggggtgaagactgcaaggttaggatgctttttttcctgaaaacttgactgcacgcttttcagtctatggcctcactgcgaagcagcgtggattagtatcttgacataacccattcagcattcgcttctagttcttccagtgaaattcgtagccattcttcatttgttatttaattttccatggttttaaattaagttattgaagaaagacactactcaaacacagttttatgtattagaagcttcatttctgtttttaaaatgtttgaatacatttgcttaaatgtcaaaaacagaaatagagaattgcatagtattctgatcaacatatcaactgatgaaatcagtttctttgttattttgagggaatgctgtatgtaaggtattgtatctttgagccaaaggattatttttattcttaatcttgatagtacgatgttatgagctatccctggggttttgggaagtgcggagtgtaaggttgtaaagttgcagaatatgaaaatataaatgtatatatgttaccttttcacactttgcaaactggcatctactcattgcattttttggcccgtaaatgggttatttccttattacattagtcttgtagttcttaagtatgatagaaggtagtcaccccagaagaaaaaaaaatccatatacaatgattccttccaactttgctgacagactattctttaacttttccttagttttggattctgacaatgccagtctatccctatacgggtccagggagaatagtactttttaaaatggggtcaagatagaagtaagaattctctagaatctcagattgcagaagtgtgaaggtttgaaggcaattaaatgccactttgcaccatttttaatactgccatgcacaaaatgaaaaggttagctagagaaattgttttacttgacctcattaatacctattcttcgtttaaagtgctctgaggtattggtcacatgaagtatgacttgaattaccatgatttttacctatcacttacagaacatttcaacaacataacttgcctttcagctctacttgagcaataatgctaaagcattggaaggtatacattgaaccaaataccgttgtgggagtagattctcatgctatcaataaaatggataaaggattcagaatttcatgtcagaattcaaagctatgtgattatgtgcatttgattctggtaagtgtaaatgacaaagtccagacatttattttacaactgcaaaataaaactagtggattttgaaagattttgtgatcctctaactggtgaattaccctatcaaatatttttcttatttataaagtgtggcaaaatagcctctgtctaacatttcccagaactaaaaacagctaatctttacagataataatctgcttataaaaaatgcaatgtcttactgtcttgacatatagcatccagtgtaaggtaagctaaggggaagtaccatgctggaaaaagtccatattttcacagatgaaataattttttaaatggtatttcagatatagcagggttatattttttagtgtaccctattttataggccctagaatcaaaacactaagcccacatatatatttgtaaatagcagggagatagacagattattttagcccagttaaattcaggtgccctactctaatagaagtaaacttaagcacagctttgtactcctttcttttagctgtaacttgatacctataacattttcatttaaattatttcacaatacacaggcagaaactttcttgctaagtatgaaactgccaaaaccaggctctataagttcacactttgtagaggatgttaattgaaagtgaaaacccaaaacaatgcagctcaattaagctcttgaagaaaacatggaaatcacaaatcaggtaggccctgtgaagaaggcagagattttaccactttaagctttgtcttttcttccttcgtcacatttttgaagtgggttctaaaaaagtgtttctcactaagacacttcatctttttgaaggttttggaaaaatgtcccatgttttaaactgatcatcacaaattatcaattagatttgtagatactgatgattgacagcttctctatatactataaaacaggagtttgaaacataaaactagtaagaagaatggtctgactcagccaatcagaattataaattatttgttttggtgatattcgatgcaatggctataatagaacttatctgaaatattatcatgattcaaaatgccttgaaattttcaacttattcttggaaacatttggggagttctgacttcaagtttcatttattgttagcggaggagtatgcattcttacattttgagtggccagttttttaggtgttgttaactaacaaaaactatatctcgtatgtgtaataacaccacaatatttattttcacaggggctaaagatagaaagattcaatagccaaatgagctacattaaaaaaatttatgtaacactgaaaaagtttagaatcctcattagaaaactgagcagatctgattattaaaataagtatattttcttctagatatttttatcaatttttccatgcttatgggcaaatattgtttccccagatacattgtttgaaataaagatttttagcacaaaatctttgtgtaaagttctgaaacttttttcaattctaaccctaaagagggaaatacctctgatagcatactgaaaaatgtgatctaactttaggaataagtagcgagattttaaatactattagttaaatttaattcatcgttttttaatattctttgttcccactaccaacacttttcttgtttttaagctccagatcttttattctgctgaaatctaatttacatagagtgaaagacgcagatattaggtgtacagatcaatcagttttgacaaatgcttcctataactcacatacttactcatatatatatagaatactcccaaaaccccaagaaagtttttttgagccatgtcccaattaatccttgactgtccccctgaagcaactattgctctgatttctttcactatcgattagctttgcatgttctagaatttcatgtaaatcaaatcatatagcaagagctctttggtgaccattttcttttgctaagcataatatttttgagattcatccatgttgttgcatgtatcaagaattcattcctttttattgttgagtagaagtccattgtatacacatctcacaattactttattgtcccgttgacacacatttaggatgtttttagtttttcctattttgactaaacctgctatgcattttcttatatgaggctttttgtggatatattttttcatttctcttgtgtaaatttcttggagtgaaactactgggtcatcagaaaggtatcttaatctgtttgtgctgctctaacaaaataccatggactagataatttagaaacaatataaatttattcctcacagttctggaagctaggaagttcaggattaaggcacctgcaggtttggtgtctggtgagggctactctctgcttccaagacggtaccttgtcacttcatcctccagaggacaaatgctgtattctcccatggcagaaggaatggaagggcaaaaggggacaaatgctaattccctccagcccttttataaggctgataatcccattcatgtgggctatgcccacataatttaattacctcctaaaggcctcacctcttaatactatcacactggccattaagtgtcaatatatgaattttgagggacactttcagaccatagcagagggaatatgttcaactttataagaaactgctaaactgttttcatactggtttaacattttatttatctgccagcagtgtttgagagtgtcagttgttccacgtttgctgacatttggtatagtcagtgttttaaatactagccatcttggtgaatatgtagtggtattccatcacagttttaatttgtactggtcaactgttacctaatgacgttgagtactttttcattgtgcttattgaccatttgtatatcttcctttgtgaaatgtctgttcaagcattttgatcatttattgcttgatttatctgtgttttaataagttgaaggtgtcttttatatatactagatttgagccgttttgatatggttaggctttgtgtccccacccaaatctcaccttgaattataattcccataatcctcacatgtcaagggagagaacaggtggaggtaattgaatcatggggtcagtttccctcctactgttctcatgatagcgacttctcatgagatctgatagttttataaggggcccttccccctttgctcagcacttctccctctgccaccttgtgaagaaggtgccttgcttcccctttgccttctgccatgattgtaagtttcccgaggccactctagccatgttgaactgtgagtcaatttaacaactttcctttataaattacccagtctcaggtatttccttataggaatgtgggactggaataatacagtaaattggtactgcagagtggggtgctgctgaacagatacccgaaaatatggaagcaactttagaactgggtaacaggcagaggttggaacagtttggaggactcagaagaagacaggaagatgtgggaaagtttggaatttcctagagacttgttgaatggttttggccaaaatggggatactgatatggacaataaagtccaggctgaggtggtctcagagggagatgaggaacttcttgggaaccggaataaaggtgactcttgctatgtgttagcaaagagactggtggcattttgcccctgccctagagatctgtggaactttgaacttgagagagaagatctgaaataggaacttatgtttaaaagggaagcagagcataaaagcttagaaaatttgcagcctgacaatgtggtagaaaagaaaaacccattttgtgaggagaaattcaagtttgctgcagaaatttgcataagtaacaaggagcccaatgttaatcaccaagacaatggggaaaatgtatccagggcatgtcagaggtcttcactgcagcttcttccattacaggcccagaggcctaggaagaaaacatggtttcatgagctgggcccagggccttgctgctttgtgcagtctcaggatttgatgccttgcatcccagttgtggataaaaggggccaacgtacaactcaggctgtggcttcagagggtgcaagccccaacccttggcagtttccatgtggttttgggtctgctagtgcacagaagtcaagaattgaggtttgggaacctttgcctagatttcagtggatgtatggaaatgcctagatgtcaaggcagcagtttgctgcagggatggagccctcatggagaacctctgctagggcagtgcaaaagggaaatgtgaggttggagcccccacacagagtccccactggggtactgcctagtggagctgtgagaagagggccacagtcctccagacctcagactggtagatccaccaacatgatgcttgcatcatagcctggaaaagccacagaccctgaatgctggcccaggaaagcagccaggagggcgttttaccctgcaaagtcacaagggcagagatgcccagggccaggggaccccacctcttgcatcagtgtgacccagatgtgagacatggagtcaaagtagattatttcagtgctttaagatttgactgctctgctggattttggacttgcatgggacccgtagccccttcattttggccaatttctcccatttgaaatgggtgtatttgctcaatgcctgtacacccattgtatctaggaagtaactaacttgcttttgattttacaagttcataggttgaagggtcttgccttgtctcaaatgagactttgggcttggacttttggtttaatgctggaatgaattaagattttgggggactggtggtaaggcatgattggttttgaaatttgaaagggagatgagatttggaggggctgaggacagaatgatatggttaggccttgtatcctcacccaaatctcatcttgaatcataatctccataatccccacatgtcaagggaaagaacaggtggaggtaattgaatcacgggggcagtttccctcatgctgttctcgtgatagtgagttctcatgagatctgatggttttataaggggctcttcacccttcgctcagcacttctcccttctgccaccttgtgaagaaggtgacttgcttcaccttcacgttctgccatgattgtaaattttctgaggacttcccagccatgtggaaccatgagacaattaaacttctttcctttataacttacccagtctcacatatttccttatagcaatgtgagaatggactaatacacctttattagttatgtgttacaactatattcaccccatctgtagtttgactattcattttttattgttatcttttaatgaaaagaagactctgattttcttgaattccaattccaatttatcctttttttttttcttttttagttaacaatttctggatactgtcaagaaaatatttttctaccacaccattgtgaagagattctcctatgtttattcctagatgatttataatttaacttttatgtttagctctatgattcatctagaatatatatgtatgatatgaagtaggagctgtgtgtcattgtttcatacatgtgtccagttattccagcatcatttgttgaaacaactttcctttatccatggaattgtcttggtgcctttgtaaaatatcaataggctgtacaagtatggatctaatatagtctatattatcttccattgattgatctgtctgtatttaacctactaccacgctgtcttgatagctgtaaatttataataagccttgatatcagatagcatcggtcttccaattttgtcttacctttttgcaagataggtttggctgttttgggtcatttgcttttccacatatattttagaattaggttctcttttggtttaataaaaaaggctgctgggatttcaattaagattacattgaaactgcagatcaatttttggaaaactgacacgttaaccctattgagtgttctgatccataaacactgccagtcttccggttatttaggtctcctttagtttttctcagcaatgtgttgtagttttcagtgtagaggtcttgcacatatttaaatgagttcacttctaagtattttatcttattgaacttattgcaaatgttaatatttttaatttcattgttaattgttgctaatatataaatataattgctttctggatattgccttgtatgactttgctaaattcacttattagtgcatgtggcttttctgtagatttcttggcatattccacaggccaaattatgtcattttcatatacaggctgttcagtttttttccttttcaatatttttggtttttatttttttccttgccttatttcactggctggggcccccagtaaaagcagacttccagaacttgcttccaattttaggggagaagcattcaatcttttgccattgagtttgatactagctatgtgttttggtatatgtcttttgtcaaattgagggactttctcattcttgagtttttactacaaatgcctgttgaattttgtaaaatgcttcttctgcatctattgaggtgatcttgtattttttttcttgattattctctttcaagtgttgaattgcattgacctattttctcctgttagtccaaccttgaattactgagataaatccttcttgatcacaatgtcttattgtttttctatcttgctatattcaatttatggatattttgttgttaaggataatttgtatgtatatttataaggaaaattaggttgtggttttcttctaatgtctttgcctcactaatagcaggataatactcaccttataaaatgaattgggaaatgtcactcttctattttctgacagaatttatataatattaatattattccttgtttaaatatttactacaacttaccattaaagccatgtagaaacattttaaatcaccacatcatcttatttgttagatatatatcgatttcaataaaacaattattgtatcaatctttgtaatttgtgtcattcaattaatttgcccattttatcaaattgtaacatttattgtaatcaagatgttcataaaacatcccaatatcctggcaatatctgtaggatttataaaaatgttctcctttcttgtttgttatcgataatttgtgggtttcttttttccctttctagtctacctagagtttattaaattcaggggcttttcataaaataacttttttttttttgctttgatttactctattgtctgttccttttctgttttattcatttcagctgtaactttataagtcttttcttctacttttgagttttaatttagtcatctttttcagctcatttaggagtacacttaattgatttgtttttcagattttatgttagatttagggggtatatgtgcaggtttgttactgtggtatattgcatgatgctgaggtttggggtatgaatgatcccatcacccaggtactgagaatagtacccccaaagttagtttttcaaactttgccccctccctccttcctttctctaggagtccccagtttctattgttgccatctttatttccatatgtacccaatgcttaactcccacttgtaagtgagaacatgtggtacttggttttctgtttctgtgttaattcacttaggataatggcctccagttgcatccatgttgctgcaaacgacatgatttcattctttttatatactgcatagtattccatgctgtatatgtattacattttctttatccaatcaaccattgatgggcacctaggttgattccatgtctttttgctattgtgaataatactgtgatgaatatgtgagtgtatctgtgtttttggtggaagtacttgttttattttggatatatacccaataatgggcttgctgggctgagttgaaagtagttgtgttttaaattccttgagaaatctccaaactgctttccacagggactgaactaatttacattcccaccaccagtgtataaatgttcccttttctccatagtctatccagcatctgttattttttgacttttaataatagctattctgactggtgtgagatggtatctcattgtggttttcatttgcatttctctgatgattagtgatgaggattttttcatatgtttgttggctgcttgtatgtcttcttttaagaagtgtcttttcatgtcttttttacattttttaatggctttatttgtttttgcttgttgatttgtttaagttccgtatatattctggatattagacctttgttagatgcatagtttgcaaatattttctcccattctataggctgtctgtttactctgttgattgtttcttttgctatgcagaagatgtttagtttacttaggtcccacctgtcaatttttgtttttgttgcaattgcttttgaggacttaagtcacaaattctttctagaagtccatgtccagaatggtgtttcctaggtgttcttctaggagtcttatagtttcaggtcttacatttaaatatttaatccacctcgaaattaatttttgtatacggtgaaaagtaggggtccagtttcattctgctgcatatggttagccagctatcaaagcaccacttattgaacaagcagtcctttccccattcctattgactttgttgaagatcgaatgattgtaggtttgtggctttatttctgcattctgacactggtctatgtgtctatttttgtaccagtaccatgctgttttggttactgtagacttataggatagtttgaagtcaagtaaggtgatgcctccagctttgttgtttttgcttaggatcactttgtctattcaagctcttttttgatttcacatgaattttagaatattttgttctagttctgtgaaaaatgacgttggtagtttaataggaatatccttgaaactgactgctctgcgcagtgtggccactttaatgatattgattcttccagtccatgagcatgaaatgttcaaacaaacatttatttctcccagttctggaggctgagaagtccaggatcaaggtgctggcagatttgatgtctagtgagggcctacttcctcacagacagtaccttctcactgtgtcatcacatggtgaaaggggctagctagctctgtgagatctcttttataaggccactaagaccaaacacaaaggttccaccttcattacctaatcacctcccaaaggccccactttctaataccatgacctggggtgtttaggatatcgacatataaattttgaggggatacatacattcaggccatcacagatacagtatcctgtaaatatgaatttgattaccttggttgatagtgttattcaaataatgtataccataactgactttttgtctagctgttctagtaattattgagagaggagtgttaaagtctccaactacaattgtcaatttgtctatttattcctatagttctatcagtttttcttcatatattttgaagttctgctattaaatgcatatacacttaagaattttatgcctttttgatatattgacagttttatcaacatgaactatatctttttttctttagtgatatttgtgtcctgaggactactttttctgatattttcatatctactaaaactttgttatgaatggggcttgcatagtatggtaatttacattttttactataatcttatctttgtcctcaggctatttattattttctgaagctctgagtttctagctggtactattcctttcttgtagtttcttatagttcaggtcaactttatttatttgaaaatgtcttttaatttacctttatttttggaggatattttcactggatatcaaattcaagatcaatagtatttattttcccaaatgtttaaatatgtcagttcattttcttctgtcttcccaaatgtttaaatatgtcagttcattttcttctgtcttgtatcgtttctgatgaaaaaaatcaacattcttattattgttctttatgtagtatatcttctttctttatatttgatttcaagtaattgtattatgatgtccataggtgtggttttctttgtgcttaccttgcttgaacacctaggatctgtggatttatatttttcataaattttgaaaattttgcccactattttttcaaacactttttctgtcccaatccttctcctcttattctgagaaacccattatttgtgtatttgactacatgatagtatcactcaggtcactgaaaatgtttattttattttttcagcctttatttctttctgagatttcatttgtaagttttgttgccttgtcttcaagtatattggtcttttctttgttagtgtttaatctgctgttaaccacatctattgtttttttatttcagttttgtacttttcattgatcagatttccattcggttctgttttgaaagattgctttttcctactgaaatttctccatcttatatatgtccttttctttaaatccttgaatttatttataatagctcttttaaactattttttgcaaattctaacatctatctcatttctaggtgatttctattgattgatttttttcatcattttgggtcacattttcatgtttcctcaaatgcctggtattttttaaattacgcattagacactgtcaatgctatagtcttaaatttcttttgttatagtcctttagggcatattgaatttttgttttggcaggtcattagttgtgcatcagctgatttcttgttctagagttgaaatagccttgtaccttagatgtgattttttttcaagtctcatcagaatgttaatgtaattcagtaatgtctcttctatctggttggttataactttaatgactgctaatacttcacaaactcgaatctctattcagttcatggatcctcaatagttgttttccactttgtatatatatatatgtagtctagtattcatctaaatatttattgtgtcccttctgtaaatttctggagcctcttcattgtttagtttcctcttgtctgttattctgcctcaaaaattccagccacctactcagtacctaactctaaactctatttcttcagctcagcaagactgccatgctctgggctccacctccctgtgacgcaacctggaaagtgcctcttggtagaaagctagggaaataattagcctcacctcctgtttttctcttctgtcactaactgttacctgtgctgcctatttagcaatagctggaaactattgtttcatgtatttttttcaagttttatagttatttacagtagaagggaaagtctagcactaagtagtccatcatggctagaattggaattacagtcccaccaagttttctaatctgagcaatgtcaaacctaaagaaaagttgaaagaagagcatgcatacacttaacttaaatttaccaattatcatcttgccaaatttacttcatctatttttaatatatacttattatctattattttgctgaaccatctgaaaaagttttagatagcatgaaacttcatctgtaaacatttcagtatgtgtctcttgagaacaaggaagttatcttaaataactacaataccagtatcacatccaagaaatttaacattgttcaaaaaatattatctaatagtatatattcaagctcccccagctgttcttctaaagtcctgtagagctttatttttaaacctaggatctattcaagaatcacttactgtgtttgaaagttatatctttttagcttcctttgatatgaaatagccctccttgcctttttatcttttataaaattgacattcttaaagagttcgggtcatgtatgtcagattgtatcctcatgaatagattcaagttaaacatttttggcaaaaaaaaaattcacagagttccgtatactttccatttgtatattatgaacagcatatattctcagttcatttctttccaagtcatgctaagtctgatcatttgtttaatgttgttcatgccagagtttttcagtgtaaggtatattttcctctttctaatcaatatgcaatctgtggggcaatgctttaagaccatgtgattgtcctgttcaacattctttcaccgaattgttttagatccactgataattcttacctgaatcagttattacattaggagttacaaaatggtgattttcctaattccataatttcttctacatttattatttaaaattgttttgtaatgaagactctcacattagctttatcttagaaacatttttgaaacctaactaaatgataaactcaggaaaaaaatccttagtatgtattttattagtgtcactgatccagcatgactgctaccactttagggatttaaactgagttccccagtcaggcacattactttataaaagtgatatagaatgttactccatcgagaaagttccctcatgtcctttcccaacccattcaatccccatcccctagggacaaccactgttcttgtttttcttaccacaaattagtttttcccattgtaaaatttcgcacaaatggaataatatagaacattattttttgtgaaaggcttatttcactgataaacatatgttaaagatttatccatgctgcatgtatcaatagtttcttatcattgctgaattgtattcctttgtatttgcacaccaaagtttgttcattaagtttcctattaatggctttgctctttccaggttttgctattataaataaagcttttataagttttgtatcaacagactctagggtggttcccctgtggatctcaactcctggtattcatgttctagtattaccaactcactttgaatgtagggaattcctgtgacttgattctaaccaacagaatatagaaaaggtgatggaatatgactttcataattttgttatatagatccctatcttgctagtagactctttctagagactctctccctagctagcttggaataagtaagcagccatgttgagaaaaccacatggcaaggagataaaagcaacctctggccaacactaagccagaagctgggaccctgagctccaccactacaagtgtattgtttaattttcatgtgtttgtttagtttccaaaattccttgttactggtttgtagttttatttcattgtagccagagaagatgctttattttatttcaattttttaaatgttttcggacttgttttgtgacctaacatatgtcctgtcctcgaaaataatctatgaactaaggagaagaatgtgcattctgcagcagttggatgaaatgttctctaaatatctattagttccgtttgttctattgtgcagattaagtctgatgtttctttgttgagttttgtctgagacatctgtccaatggtgaaactatgatgttgaaatttccagctataattgtattggattctatccctctctttaggtctaataatatttgctttatacatttgggtgctccagtgttgggttcatttatctttacaatcattaaatcttcttgctgaattggcccttttatcattatataagagaccttttttgtctcttcttacagtttttgtcttgaaatctatttggtctaagtatagctattcctgttcttttttggtttccattggtatggaatatctttttccatccctttattttcagtctgtttatctttataagtgacatgtttcttgcaggcaacagatcatggcatcttgtttttttatccattcagccactctatgtcttttgattgaggagtttagtttatttacactcaatgttattattgataagtagggagttactcctgtcattttgttgttttctggttgttttgcagtcttctcttccttctttccttccttccttttagtaaaagtgattttctctggtggtacgttttagtttgttgctttttgttgtgtagccattttttttttttttttttttgacaaggactcactttgtcacccaggctggagttgcagtggtgagatcacagctcactacagccttgaccttccaaggcacaaggcacaggtgatcttcttgccttagtcccctgagtagctaggactacagtcatgtgccaacatgccaggctaatgtttgcatttttagtagacatggggttttgccatgttgcccaggctggtcgtgaacttctgggctcaagcggtaagcccaccctggcctctgaaagtgttggaattacagatgtgagccactgtacctggccatttcaatttgagattaccatgtggcttgcaaacactgtgctataacccactgatttaagctgatgatagcttaacactgatagcataaaaattacaaaaatatgcaataagaaaacttataaaaactctatactttgtcttcttgagttttaactttccattgtttctctttatgtcttattgtactatctatgtcttgaaaagttgtcatagttattatttttgattggttcatcatttagtctttctacttctgaaaagtaatttacacaccacatttatagtgttttagtattctgtgtttttctgtgtgcttataattaccagtgagttttgtacttttgatgatttcttattgctcattaacatccttttctttcagattgatgaagtccctttagcatttcctgtaggagagctctgctgttgatgatattcctcagcttttgtttttctggtaaaatatgtatttctccttcccgcttaaagaatattttcaccagatatactattctaggataaagctgtttcctttcagcacttaaagtatgtcatggcactctctcctggcctgtaaagtttccactgaaaagtctgctaccagaagtactgaagttccactgtacattatttgttccttttctcttgctgtttttaggatcttttctttatacttgatctttgggagtttgactaaatgccttgaggtagtcttctttgggttaaattttcttggtattctataaccttcttgtacttgaatgttaatatctttcttgaggtttgggaagttctctgatattatccctttgaataaactttctatccctatctctttctctactttctctttaaggccaatgactcttagatttgcccttttgaagttgttttctaggtcttgtaggcatccttcattgttttttattcttttatctttcgtctcctctgactgtatattttcaaatagcctgtcttaaagttcactatttttttcttctgcttgatcagttctgctattaagagactctgatgcattcttcagtatgtccattgcatttttcaactctagaatttctgcttgattatttttaattatttcagtctttttgttaaatttatctgatagaattctgaatttcttctctgtgttctcttgaatttctttgagtttcctcaaacagctattttgatttccctttctgaaatgtcatatatctctgtttctccaggactagtccctggtgccttagttggttcatttggtgaggtcatgtgtttttggatagtgttgatgcttgctgatatccttcaatatctgggcattaggtatttactttaatcttcacagtctgggcttgtttgtgcttgtccttgttgagaaggctttccacgtatttgaagagactttagtcccaagcctaatcatgctgtagtttttgcagactcgtagaggtaccaccttgatggtcttggaaaagatctggaagaattctctcaattatcaggtagagtttcttcttcttttcccttacatcatgccaaacaaatagagtctctctttctctctctctctctctctgtgttgagccatgtggaactgggggtgtggtgatgcaagcacccctgtggccaccaccactggcactgtgctgggtcagacctaaagccagcacagcattggacctcgaccaaggcccttcccttcatggtggcaagtttccccaagctctggtcatgtccagagatgctgtctcagagcctcagattggagtcattagcaatttagttaatgttctattttactgtgtctgagcttgccctcaaaccatagtgcaaaatccttcctgatcttcccacccctttccacaggcagaggagccaccaccacataagtcaatgttggctacctggacactgccaatgtttgcttaaagccccagggctcttccatcagcttgtgaatgctgcctggccagagactcacccttcagggcagttgactccccttttgtcaagggctagtccagaaatgctgtccaagagcttagacctggactcgaggaccccaagagcctacttgttgctctaccacactgtggctgagctagtatctagggtaccaaagtcccctttacttttccctctgcttttctcaaacaggagtcttttattatagccatcacagctgggaatgtgctatgtctcccctgaagccgacccatagcccaaggcccacagcatactccctaggtatcactagtggttagttattcagggcccaaagtttctttagttagcagttgatgaatgctgctaggactgggttcctcccttcaagggactaggttccatttttgcccagagtgcatcttttgctcacctgatttttggttcttgtgatgatgcttttctgtgtggagatagttattaaaatttggtgttccaggagcagggagatgaatggcataggcttctattctgccatcatgctccacccctctattaaccaatttttattttggttgttagtctttttataattaacttgtaggcgatatatatatatatctagatatatatctatatatatatctagatatatatatctagatatatatctagatatatatctagatatatatctagatatatatatatatctagatatatatctagatatatatatatctatatatatatctagatatatatatatctatatatatatctagatatatatatatctatatatatatcctgaacactagtcttttgtgatttgcaaccatgttcttccagtatttggcttgcttattcattttctcaattgtatattttgttgagaatttaacttttattttaagttcaggggaacatgtataggtttgttacacaggtgaacacatgtcagggggtttgttgtacagattatataatacccaagtattaagcccagtacccatagttatcttttctgctcctctccatattctcaccctcctccctcaagtagaccccagtgtctgctgttttcttctttgtgttcataaggtcttatcatttagctcccacttataagtgaggacatgcagtatttgattttctgtacctgagcttgtttgctaaggatacaagcctccagctccatccatgtccctgcaaaagacatggtctcattctttttttcattcttttttatggctacctagtattccgtgatgtatatgtaccacattttctttatccagtctatcatcaatgggcatttaggttgattccatgtctttgttattgtgaatagtactgcaatgaagatacacgtgcatgtgtctttataatagaatgatttatattcccgtggttatatattcagtgatatggtttggctgtgtccccacccaaatcttatcttgaattttagcttccataattcccacgtgttgtgggagggacctggggaaagattattgaatcatgggggcggtttccaccatactgttctcatggtagtgaataagtctcatgagatctgatggttttataagcagaagccccttttgcttggttctcattctctcccttgcctgtcaccaatgtaagacataccttttaccttccaccatgattgtgaggcctccacagccacgtggaactgtgagtccattaaaccactttttcttcataagttaccaagtcttgggtatgtctttatcaacagcatgaaaaatggactgatacactcagtaatcgggttgctgggacaaaaggtgtttctgcctctaggtctttgaggaatcaccacactgtcttccacaatggttgaaccaatttacacttccaccaacagtggaagtgtaagcattcctttttctccaaaacttcatcagcatctgttttttttgactttttaataatagctattctgactggtgtgagatggtatctcactgtggtttgatttgcatttctctaattatcagtgatgttaagattttcattatatgattgttggctgcacgtacgtcttctttggaaaaaatgtctgttcatgtcctttgcccactttgttatggggttgttggtttttttcttgtaaatttgtttaggttccttatagataatggagagtagaccttagtcagatgcatagtttgcaaaatttttctcccattctgtaggctgactgtttactctgttgctagtttctttttctgtgcagaagctctttagtttaattaggtctcatttgtcaatttttgcttttgtttcaattgcttttggcatcttcatcatgaaatctttgctgtgcctgtgtcctgaatggtattggctaggttttcttctagggtttttatagttctggggtttacatttaagtgtttaatccatcttgagttaatttttatatatggtgtaaggaaggggtccagttataattttctgcatatggctagccagttattccaacaccatttattgaacaggaaatcctttccccattgttgtttttgtaaagtttgtcaaagttcagatagttgtaggtatgtggttttatttctgagttctctattctgttccactggtcaatgtgtttgtttttctaccagtaccatgctgttttggttacagtagccctgaagtatagtttgaagtcaggtagtgtgatgtttccagctttcttccttttgcttaggattgccttggctttgttttggctcttttttggttccatatgaattttaaaatagtttgttctagttctgtgaagaatgccagtggtagtttaataggcacagcattgaatctataaattgctttgggcagtatggccattttcacgatattaatacttcttatccatgagcatgaaatgtttttccatttttttggtgtcatctctgatttatttgagcagtggtttgtagttctctttgtagagatctttcacctccatagttagctgtattcataggtattttatcattttttggcaattgtgaaagggagtttgtttctgatgtggctcttggcttgactgttgttggtgtataggaatacttatgattttttgcacattgattttgtatcctgagactttgctgaagtcacttatcagcctaagaagcttttgggatgtgactatagggtttcctagatataggatcatgccatctgcaaacagggatagtttgatttcctctcttcttatttgcattccatttctttctttctttctcctgcctgattgccctggccagaacttccaatactatcttgaataggagtggtgagagagggcatacttgtcttgtgctggttttcaagaggaatacttccagcttttcccccttcagtataatgttggctgtgggtttgtcatatatgtcttttattattttgaggtatatttcttcaatacctagtttgagagtttttcaagataagtaggtgttgaactttatcaaatgccttttttgcatctattgagataatcatgtggtttttgcctttagctctgtttatatgatgaatcacatgtattgatttgtgtatgttagatgaaccttgtatcctagggataaagcctacttgattgtggaggatggggtttttgatgtgctgctgaatttggtttgccagtgttttgttgaggatttttgcattgatgttcatcaaggacattggcctgaagttttccttttttgctgtatctctgccaggtttcggcatcaagatgatgctggcttcatagaatgagtgagtgaggagtccctcctcctcaatttttttggaatagtttcagtataaatgtgtattagtctgtttgcatgctgctataaagtactacccaagattgggtaatttataatgaaagcagtttactcacggttccacattgctggggcagcatcaggaaacttatgattatggcagaaggggaagcaaacatttccttcttcacatgatggcaggaaggagataataagagcccagtgaagggggaagacccttataaaaccattagatattgtgagaacctactcactatcacgagaatagcatggaggaaaccacccccgtgattcaactacttcccactgggtccttccaatgacatgtggagattatgggaacaacaattcaagatgagatttgggtgaggacacagtaaaaccatatcattttttctttcattttgaccttggagaatctgatgattatgtgtcttggggatgatcctttcaagggttgtcttacaggggttctctgtatttcccgaatttgaatgatgtgaatgttggtctctctggctaggttgggaaagttctcatgaatgatatcctgaaatatgttttccaagttggtttcattctcctcatctctttcagggacacccatcagtagtagatttggtctgtttacataatcccatattttttagagttctttttatttccttttcattcttttttttctctattcttgtctgcctgtcttattttagaaaggcagtcttcaagctctgagattctttcctctacttggtctcttctgctattaatacttgtgattgcattatgggattctcgtagtgtgtttttcagctctatcaggtcacttacattcttctctatgctggctattttgtctgtcagcacctgcaatgttttatcacgatttttagcttccttgctttgagttacaacatactcctgtagcttagggaactttgttcctatccatattctgaattctacttccatcatttcagccatctcagcctcagcccagttccaaacccttgctggagaggtgatgcgttcatttgaaggaaagaaggtactctggctttttgagttttcagcattcttgtgctgattctttctaatctttgtgggcttatctaccttcaatctttgaggttgctgacctttggattttttttttcttttatcctgtttgatgagcttgagggtttgattatagtacaaggtggattcagccaactagtttcatttctgaaagatttaacgggccaatgttcagctcccaactcctggactgtgtgctctaactctgggggacttgtattggaccctgactttgttctctggatactccaggtttggagtctactgcactgtggggactgaggtgcagcagttgcagacaagtgttagtggattcagaggtgcccaactccctgtgggcattcaccacagtaggcattcctctccatgagagccacacacattattggcagttgggtgtggggagtgggggggcccttgctggagactgtttgtgctgttgcactggaggtgttgttggtttggggtgaagtgctggccagtgcaggtctggtgccttttctgagccctgcaagcaggagttattactcagggtgtgggaggatcccctgttccctgaacagtgttagcgcaagagcagggcactggcaggggtggggcttgctggatttgtgcccgccaaggctctgtctgcagtggtagtctgtgggggtcggggtgcatactgcagtcctatgtgttggcggggcaattaaagtaaaactcgtgcagacacacaccagcaatgtgatgtggggagttgctgtgggctcaggggatgctgcaatatggggaagcaatgtgtgggttggtgcacagtcataggtgccaccttgctggagctctccatcagtcaggtatggtccactggctcagaagctatggtatgggtatggtatggtcccccaggggacccaagactgtcctgtaagtaggtgtggcgaggctggggtcccgggagaggccaacagaccaagaagtgcttaggttggaccagacctgtctgatgtgcaagacctccctgtgaagatcaggttcaacaattcccctagggctaaaaagtctcttaagagagcaagtcgagcacagggggatggctgtctctcaccacgctctgctacagatgattctgcaccaaaccctctgggctccacatcagctggcttgctgctccaccactttgcttctctcctgggggctctaccccagagagatgttgcttagcagtagctcagggcaatcagcccaggatggagggtctgtgctgtgggcctaagcctggggtttcttgtctggtgacaagcagtgggggtgtgtaggacctgtgggagatggactggcctcctctccttgggttgactgcagcttgttggaggtatggataaagcacttagggccttggcttttttgttaacctgagggtaagaagggcagttccactgcagaggcagtgatagataggctttcaatgtccctaaaggctctgtccagggagttgctgagttgctactggctcgatagctctgtcagagggtggctagaagcccaggcttggaggacctgcccagtgaggagatatgggaatgggcacccctataacagtctgaccacttttccgtatggctactgaagtatgctggggacctgctccagtccctagtcgcctcgaattttccagtacctggaagtatcaccagtgaaggctgtgaaacagcaaagatggcggcctgcccctccctgtgggagctctgtcccagggaggtgcaggactgttgctggctgaacacacctgttggaggtgcctgaagaccccagttgggaggtcccacccagtcaggaggaacaggatcggggactcactgaaaaaagtagtctggttacatttttgtagagcagctgtgctgtgctgggggatctcattcacccctggtctgtttggactctccaaagcccaaaggcagtaacggctctctctcaaacagcagagatggtggcccacccttcccccgaggagttccatcccaggaaggtgcaatgctgctactagttgcaggctggaattccaagttactgggtctcatcctggaattccaagtgaggcaccgtggaaatgtggcccacagactgtcgctgctcggccgcctggattcagcctccttcctaggggtatgtatggtgcgggggtggggggcggctaacttcccgctttgctggagttgcaactacttttggtcggatgcctggaaagccagagtatctaaagctcctgagtctctgcgtgcacctgagcggctgctctgccaaaactcaacagatgtctgtgtgtcagactgaaggccccgatagagtgggttcatgaggggatctcctgacctgagggttgcaaaggtccatgggagaagcttgggttcctggggttgcacattcgctcatggcttctctgggcaggggagcttcccttggctccatgtcgctctgggtgggcagtcatcctcccttgctttttcactgttcttggtaggtcgagttgtttccttgattagtgccagtgtgagtacttggatgtttcagttgaaggtgctgtatttacttgtcccttccattcctttccgtgagagccacacacattatctgcttctagttggtcttcttggccactccccagagaaatttttaattttgatggtagagtttatcatatttttcttttatggttcttactttctgtgctccctcaaagtcacaaagatattttcctgttttcattgtatgctttatagttttagcttttctgtttaggtccatgatccatctcaaattaatttttgtgtacggtataaaactaggatcaaagttgttcacccatctccatgtaggtgctcctttttttttttttttttttttttgagacagggtctgactttttcacccaggtcagagtgcagtggcacgatctcggctcactacaacctctacctccctgggctcaagggatcctcccatttcagctgggactatgggcgtgagccactgcacctggcctagcataaatttttaaaagactttccttctataattggatggctttgtaacccttatcaaaaatcaaataaccatggaagtgtgggtctatttctgggttctccattctgcaccattgttctacttgctaatccttatgtcagtgccatggtttcttgattgctttagctttgtagtatatatggaaatcattttgtataaaatctgcagctttatttctttttccaaaatgctttgggtattctaggctccttacattttgatatacattttagaataagcttgtcaattttttaaaaatatcttgctgggattatgacttatattgctttgaatctgtacatctgtagggagaattgtcatcttaacaacttgactcttcaaattcccacttattttggtcctttttaatgtcttcacaatgttttgtagtttttgggttagaggtcttgcaatcttttattaaattcactcctatccagtcaatactttcgtagctattgtaaaagcattaaaacatttttattttccaactgttttctgcttatataatgacagcatttttgagctcttactttatgttatatctatgacttcacccttgctacctggaaaatagactaaacccatctctagtgcaaatgaaagactttcaaaacacatatgaaaatctgcttggtgtgctcatttttcccctaaattaccatatctcctctgccacagcttgatatcagctgatgccatcatcagaacctgtataatcctataccacttagtggtgaataaaagtgttctagttgtccttatgaaccactgaccctctatagctgaatggagtacactagattctttatcacttataatattatgtgatcatggtcttcaaacccacaggtcctaaatctgaaacaggaagtgtatttgtgtgtgtttagaaaattacacttgaacttattagtgaaaatagaatgatttttattttatatatgactaattggtcatagtgacaataatatgctatggctgtaatgaagttagaaatggggagtagaaagatttttatatattaccacttgactaatcacaggaagaaataaagtcagaggtggagataatctatttcaatgatttttctttctgtaccctgttactattttttcattagaaatattacacagagttcaaatattttttaaaaatagaaaagagcataattgctctggcttaagtgatggtagaggttttagatctaatgtcttactgtggaaccttttttgttatgctaggggtcagaggagaagttgggaaaattgcagacctactcacatcatcctattttaaagaagtaaggacaataatcttggttcttaagtctggcctagcaatttacacaaatttttgtatctgagcaagtcacttaactttctgttagtattagtttctcatctgttaattggggacatgatatctgttgtacataccatcaagttattgtagggattatatgagacgacgcaagttgaaagggctttagaaactgtaaagaattccctacatgtaaaattacattatcattgttacaaaagtcacctctccattgcaataacattttagtgataaaaggatggcttatataataaactaaattgggtgtgtcttatagcaacggctgtcttatctgtagtgttagtcctgtgagattttatcatgtcttattatctgtggaagataaatgatatctgtgtggtgacctgatgcagaccagtcacaaaccaagggatcagaagaattgttataaatatataatgtaccagatctcaaaataatgtaccatagcaatgaacagtaggaaataaggtggattattttgaagcatggccatgggtcacaactgacaacttcctataatcacaaaccctgtaaaatatcaaccatagcttgtgactgatggatgctcttccttccagtcattctaaagaagctgacacatctatattcatttcataggcatgagttttgaacactgtatcccttgatgtggattgcaatgatgtcagcattataaaacaaccatagatatttgtgttgaaagttaccaaacacatgcacatgtatgtttatcgtggcactgttcacaatagcaaagtcttggaaccaacacaaatgcccatcaatgatagactggataaagaaaatgtggcacatatacaccatggaatagtatgcagccataaaaaaggatgagttcatttcctttccagggacatggatgaaactggaagccatcattctcagcaaagtaacacaagaagagaaaaccaaacactgcatattctcactcataagtgggagttgaacaatgagaacacatggacacagggtggggaacattacacatcggggcctgttgggggtgggggtctggggaagggatagcattaggagaaatacccaatgcaaatgacgagttaatgggtgcagcaaaccaacatggcacatgtatacctatgtaacaaacctgcacgttgtgcacatgtaccccagaacttaaagtataataataataataataaagaaagttaccaaactaaagcataaacaatccttcagatgatcttttagtaagagaaataaataggtgtaatggtctgacctgtagtttgtttttgagtttgtaagtatctgaagcttgaggttattttggaatcaatagaagagctaatttattaaaataatttgatttatattaatcagcaagcacagtgtcacatacttaggtttcaaagtgttctcctgctcctagaccaagtaggcacttgaaaagaaatggaaaagagacacgttaacttctctgggaagaaggcaattatttcatcttttaagtttatattcagaacacatccacagcaaatataatttaagcccacatcataaatattccacaagaaatgttcaccagttcccagaacttgaagtcacctctttggacaccagaccattctgtgacatgccatcaccttcatctaggagataacaatcacagcatatttattatgttgctcttaagtagaaaatatctgtaaagaatattgcagtacccctctgaattctatagaaagagtcatcctttaaatttttctcccatctaaatgtttacttgtctcaccaaacatctggagctcagggggcatgaggagctcatttatttgatgcagtgcttctacattgattttagaaggaaaacaatacactgtgccctaaataaagctcctagaaaaatctaaagtgttttgttgttgcggtggtggttatcctggattaccatgcggtctttttttctctccttacacacacatattagtgaagcatgcaaaccatggaaggcacctttttacatatatagcccctaccctgcataaaattgtctaggttgtctgcaaaacctatgcttctaagacagtcagagcccagcagggggataatatggacaataataagtaaatagaaccaaaacactaggcacaattcaattaagcaatggtacatgggatctaagaaatcttttcttaatactctccaggtcatgatcatcaatgcaggcttctaatatgagggaaagcagagggttaaatggaaacattgtatgtaaagaagtcaatatatatgaattaatgaaaaaatccagcccctcgtacaatacctcaaatacattaagtgctcagaaatgtttactgttttcttacatctttctatctcacctttctcctcttggctcacttgtgaaataatgtaaaaaatttaagacaaaaaacatgggagaatatttttatgagctcagtgtatgtttttctttttttaaatgagatgcaaaaaatactaacaataaaagattagatgtattagtgtacattaaaatgtagaacttcagttcattactaaaagtgacatagcaagcctaaaattgaggaaatgtatttacaagacatacaactgcaaaatgattggtatctagaatagttttaaataaatatatttttaaaaccatgacaaatcaataagtgaaaatcacagtccaatagctaaaatgggcaagagtcactacaggaattttgtaatatgtgaaacgtgttgagcataaaaacagatgtttatttcattactaatcagagaaatacaaattcagagaacggtggaatagcattttatatatctgaagaaaagaattatcaatacaaaatgttggcaagcatgaggatcaataggcacacttagaatctgctgaggggaaagcaaatttgacaaacatcttggaaaacaatttggtattattttataaagttaaacatttgtctccactatggcacagaaatctaactcaaaagtaggttttggagaaattattgcacatgttcaccaggagaacaatataggaaatgtgtatagcagcattgttcacaataatgctaagaggatggataagtaaatggatgaatacattttggtatattgaaaaaataaaatatcatatagcattgaaaaataaattatggctcatgcacaaaaaatgtataaatcatagaaaaaagtagaaatgtaaatcacaagagactatagtgtcttcatatatatattcatttttcataaagctaaaaaacaagcaaaacgaataatatactgtttataaatacataaatatgagacaaaaccagtttataaaacaagagaataataaacatgaaattgtgaatggagttatctctggaggaggcaaggggctgaaatagggaagaagtccacaggtaaagtcaatagctttggtaacgtggggcaattagtttggagactgggctctcaggtgtttattttattattatgtgttgtatatggcaatatctattaaatatattctatatgcattaaatattgcatagttttcagttaaaatattcaaacaacgtcagctcctgatggtgaatacctactcactactttactgagtcttgtatgctctcatctcctttgatactaatcagacctagaccttgaggggcttagagatgatctttgttggctctgcatttcaactctccctatttctcaacaccaggccctcggacccttgttccctactcctggatttcaatctgctaccctgtctgatatctcaattacttacatgcagatttcttggatatctccctttctaactagaattctaaggagtgttttccacaaagcctctgttttatgcctagctattgggatcctgttctttcaggatcctgttctttttttgattttgcctctcaaatatttcttcagttgtgattaaaacttcagtgcttcttagattcacccctattcagctagctgcacctcgcaattcagcttctattgctatgaaagttcctccagcacttgtctcctgccattggttgggttttgcatttatcttttgccctacatgcttacattactcagtggattcatgaagtgtctcacccaaattctgagttaacgtgagaagaataaaaatggcaaagagaatttttgagatagttaagtatagcaaagataataaccaccacttttgaatttctggaattctgaaatacattcatagaagtatagctcaattattatttacacttagtgtaaatctaaggaaattattacacagatattgtcacattgcagatttccctttcagaataaggaagacttttttttctggacagaacttggcacacttaattgagtatgcatcctgacatgctaaaatatgaacactgatgacccctgaaatttttatcagatcagagcaaaaataaattcaactttcataatttatctttctctttctcaaacagaatactaaaatgccagtttcctgccttttgaactacttttagccaaattcttggaaggtgaagaaacttgtgtgggtttaaattcttttccattaacatgcattgttctcatttccaaagattattcttacatattaagcatttatttccctaagtccccaaaaagcatttttaaagcacttaagtatttgctaagatctgccaagatcccatccttttcctttggttgcttaatcaatatcttcttttgttcagtactctgattttcaccttcaaaaatctcttgatggcaatgaactctgctctccttagaagtcatatgcccttaatattcccaagcaacattttctcactggagaagctgtttgaaatcaaaggaaagcttttaaagatgtgtatcatttggtctccttaagctattctccgtgtgtggtagtttctttttaatctctaaggaccaacttgaattttggaagagagacgagtcatctacatgcttcgcatttcaccagccttaacaagtaaaacctgatgttattagaatcattgatatatctagtattgaaggtggaagagaccttaaatgtcatctattcaaactattcatctaacttttcattattcagacagttaggaattcatcgacaaaggcgttgaaaagaggcataactttatcctttataattaatgaatttagtaagacgcattcttgggtccctagaaatcatatctacagcagccaagagaataagaatatataatttcctttaaaaatgagaggaaaatctttgtacgcttatttgtaattgaagaatattttatttctcttttctgaccagcataatgtacagccatttgagaaaatattataaacagtaggtatgtctaaatttctattcagggtttggtgtttttatagtctgctcataaaatatcttctagaacctctccttctgtaactttttcactgaggtaaattctctcacctttttgtagcccacactatattttcaacatcttagcatttgtaatcattatcatgttttgttaaaacacatcctttcaagaaaagaattattctagaactgctgaatttcaggctttttacccctgccttgatggtaccagaacatggcaaatgtaattaatctgcccaaacacaaaagttgtgaatttattgtggattattattcattgaaaaagaaaagaattaacatttaatacgtgccttaaagcacattaatggcgttttttcaaagcctaatagttagatgtatatgatctatgtgtgtgcattaagctagattttttaacatataaacatagagacagaacatgccttgatatatattctattttcataaaaaaatgtggcttaaatagagctgtggtccccaaaggaaagcacatgttgagtgaacatttcaaatatgtctgggccagtttagtctatggctatgtctatataatataaactaaagagtcagagccactgaatatctgccaaattgattagccattgggtggccagaagagagagaagagacatcttaattagttaggttgtttgattttagcctctggataatacggtcctagatcacccaatccagtgcattacattaccatttgattttgcttcactcagacaagcattgatttaactgcttttctctgaatttgtgcttctttgaataaattggtgatatctgacaagaagatctgtagaacaacatcatattgaaacgtcccagcacctgtgtagactatggtcagtgggcactagcatgaaagtttccttttggctccttgcaatttgtattaggatgtaattgtgctctctgagagcctagaagaggcaaaggattgatccactcagagagaaaattggatctggtgctattctaaccatctttcggactattctgccagtaagtgctttaaaaaaatccccatccaattcccatttggacacatagaaccctcttagggctgattagcaatttacttacttgttcattcattcattaattcatcaatcatttattcagtatcttctatgtggcacacactgtaatagtcatgggggatactaagataaataatggtcatgtctcttcctcagaggagctctgcctcagttgcggttttaataaatatccaataaggtagatgcagaatatggggtagaaggaccttcctccactgtactaaggtcctccatgactttgatgttatgctttaccttggccctactgactcttcagtctattttatggctataaggaaacagtgtgcaggtgggaaagaaaagcctcgaaagatagatacctgtgcttctcattcacatgtacttgtaattttaaaccaaaaggcatccttcaattcagtagtttaaatataacacatgtcacacagttaaagggcccatatcttttgtttaaatttcactgcagtatcctgatatgtcttattcatacatattgttaaaagtagatatgggcctgggatactggctctaaaaacgcaaccaacagagatgatgttggattacattgactctaacctgtctgatttctctgatttaaagctattagcattatttaaaaatatatttaacattatctacagggagaagttgctgttaggttggcatgggaagggaaaacctccacaccacgtattccatttgttaaggaaagaattaggataagggcaaatgttaggggaactgtaaaatgagaaagaaccaaaatgacaaatgcaaatttctccctaaatttgacaaacagaatgttggtaaatgggtaatttggtagcagttaaattgttgagtcaaaagtgcaaaaccttttatggacagaaatcagctagactaatctgttttgtcagcagggagggaagacaattcaaatgtattttacagaaagactataaatgtttatctttatccaaaaaggagaatacatacatctgtttgtttaaaacttgacatgtatattttctatgtttgctgtgatatttgtcttttggttttgtaccgaaatatttcaaggttcttttaattatttgccctaggaaatatgttggcatcctgtggtataaaataggcagggtttactctagaaaattagggaagaaactgtgaatacatttgtttgggtatggattaaaatatatctacatctaaaataatataaaatgtttatattggcattgattaataagaacatattgtcccactaccaaggataattatattttatgcatacagatatgttcaatgcagatgtcaaactgtgtgctcagtaattagtgttacctgcagcttgagtaaaactcaaaattggtatgctaactgcattcagtgattacagtacataggaaatgaatacaacacatcataaggaacacatatatgcttaaagaatttatactacatgctaaccaatttattccttaaaatataggcatttaaaatttgttcatggtaatgtggtgcatgttttggacaatggcatatactattcaagtgcttcctaataatttacagctatttttaaattgggtcatgtcttgccctgcaaaatgataacgttcttgtttatcattctgctcaagtcacactatggtagaatgaatcagttcttatgaatactgcagcacagtaaaccctgtttttctctgcatttaaagaaacagtctgttgaatagatggataaggatatggttctcataatttagagtgtatcatttttgtggtcaatgctctccaactgggtgtttacctgtacagcaaacactacaaggaagctcagggaagaaatcgaccatgcaatttatgatttcacatttgtttctgcttgcagtcaaaagcacaatattgctcagagctagtctgctgtatgcttaagcagcatattttcaggagtttttatttttaggactaacactgcaaagatgatggttacatcaggacttaaaactaaggatatgtctaatcagagataagcattctgataaaagaagaaaaaaattctaaatctatccaaataaccaatatttgattatataaaataaaaacaataatgccatttacttcgtcatactttatttcattcaaaccatacaaaacaaaaccctttttggaacaaaattatgttttctattttacatatatggcaactgagggtcagctaggggatttgatccatctgtatctgacaccaacatggtgctctgctaacccatggatgcataaactaaacatgtccaattacctgtatcaatgctatctcatgtgagttttttttttcacgtatctcaggtgccttcagtatatataaaattaaaaataaaattttggccattttctgacaacatggagataataaatgagataaatcgtgaaaagcctccactgtataactagaaagaattgcttattactggttccaaaacttcagatattatcatcatagtgataatatctttcgcagtaaaagatactccttttgaaaatgtttatctggtcttattattacaaataaatattactaattttatttctttagttataaaatgcattgttgcttttagatatttaaaatgctatcctgccattgtttgagggtaaagaaacaattcttctcactggatttaagatttactagttaaaaaccatattaaacaaacataactttatagttgacatcaataatactaactagtcacgtgaattaaatatcagatccaaattatggattgttcagatgtatttcccacttttgctttatctgatgtggtatctgaaacatactaccttgtataaaacatcattctgtgttacatgtcagttcatcacgttaaaagtctttgcttctgtctttagagatcatataatttgacatgtgtgccatttgaaattactctgaaaaaattagtttctattattctagtaaattttcttcagcaattgtttctgtatgtcatcggggtttcataccagtcaacccatatcagaccctttcatctctcacatcaaatctgtcctgtttcctctatgtcctaaatatctcacagatggttccattttatttccacctccacctctactaccgtagttcaggccatattgtagcaggtaacctttagggtaatatttggcaagaaagcatcaaaatttacatattcttggtcttttttcttggattgtattcaatgttctgaggattagaaaacattcttatgagtatagcagaagttggtgaggatcaaagaaaagaaacaaaggaaaccattctgtgatctctcctcagcaggtccactatcctctctaatgttcctggggttttttctttataatatatatcccagtttgtgaacacttgtttcagtgaattttagataccattaatataagatgcgccattatttgtatggattactgaaaacaaactaaaaatgctgccaattaagttatgacgcaacatcaattattagatgcctcaagatctcagagatgattaaatgtaaaaaaatatatgaatcaaagcattatgggatttacttacatataataatcatacatacttattgtctgtcttttccactagaatctaagatacatgagggtaggaaacatgtctaactttttttatcatatgctcagagaaactaatataatccttggtataaaatcagggctaagtatgaatttgttaaagcaatgaatgacacaggtaggctctaacaatatttcctatggctcaatgctaccatgtttattttgtgtgtggcatggtagggatggtggatatttatttaaaatattaaaagtacacataggaaccggagaaagagatctaagaatgaccaagaatcttagcactgaaagactacttgtgttatagactaaatcttgatacttaagaaggatccttatgagacggcacacaagaatattctacccaacattgtttctgaacatgcttttctggaaaaatgccacctgatatttgataggtggagttgttaagggctgaatgccaatcaaggaaatattgtccagctttctaagaggctaacagcattaaagaaagattgtatttgcttgagttaaaacatacagaaccactatttatacataagactcgatcaatcctgatttcaccaggtggagatgtttttcggctataaaacttctggataattctcaaacttcattgaataattataaaatggagatctgtggaccccactcccaggtattttctgaattttgttttcttattcaaatatatttcatgaaaattcttcaaagaaagcttgcatagaagtgatccattcttttttaatggcttcagaagatactattttgaaaatgtaggagaatttatttaacaatgtcctttttgaaacacatgcactttttacatttttttttgccacgatcaacgatgatatatgtatatgaaggtatatatatgtacatccatatatacacatatatgtaaaataagtgtatctaatagtaataagtgaacatagtagataaggtgtccatatctattttttttattttttactttttttaaattataccttaagttctggaatacatatgcagaacatgcaggttacataggaatacatgtgacatggtggtttgctgcacccatcaacccgtcatctatattaggtatttctcctaatgctatccctccccttgcccccacctcctgacaggccacagtatgggatgttcccctccgtgtgcccataagttctcattgttcaactcccacttatgaatgagaacatgcggtgcttggttttctgttcctgtaatagtttgctgagaatgatggtttccagcttcatccatgtccctgcaaaggacatgaactcattcttttttaaggctgcatagtattccatggagtatatgtgccacattttctttatccagtctatcactgatgggcatttgggttggttccaagtctttgctattgtgaacagtgctgcaataaacatacgtgtgcatgtgtctttacagtagaaggacttataatcctttgtgtatatacccagtaatgggatttctgggtcaaatggtatctctggttctagatccttgaggaatctccacactgtcttccataatggttgaactaatttaaactcccaccaacactgtaaaagtgttcctgtttctccacatcctctccagcacctgttgtttcctgactttttaatgattgccattctaactggtgtgagatggtatctcattgtggttttgatttgcatttctctaatgacccgtgatgatgagctttttttcatatgtttattggccacataaatgtcttcttttgaaaagtatctgttcatatcctttgtccacattttgaaggggttgtttttttcttgtaaatttgcttaagttttttgtagattctggctattagtcctttgtcagatggatagattgcaaaaattttctcccattctgaaggttgcctgttcattctgatgatagtttcttttgctgtgcagaagctcttcagtttaattagatcccatttgtcaattttggcttttgttgccattgcttttggtgttctatgaagtctttggccatgcctatgtcctgaatggtattgcctaggttttcttctagggtttttatgttttaggtcttatgtttaagtctttaatcaatcttgagttaatttttgtataatgtgaaaggaaggagttcagtttcagttttcagtatgtggctagccagttttcccaataccatttattaaatagggaatcctttccccattgcttgtttttgtcaggtttgtcaaagatcagatggttgtagatgtgtggtgttatttctgaggcctctgttctgtcctgttggtctatatatcagtttcggtaccagtaccgtgctgtttcggttactgtagccttgaggtatagtttgaagtcaggtagcatgatgcctccacctttgttctttttgcttgggattgtcttggctatttttggttccatatgaaatttaaaatatttttttctaattctgggaagacagtcaatggtagcttgaggagaatagcattgaatctataaattactttgggcagtatggtcattttcacgatattgattcttcctatccatgagcatggagtgtttttccatttgtttgtgtcctctcttatttccttaagcagtggtttgtagttctccttgaagaggtccttcacatcccttgttagctgtattcctaggtattttattctctttgtagcaattgtgaatgggagttcattcatgatttggctctctgtttgtctctgtttgtcgtataggaaggcttgtgatttttgcacattgattttgtatcctgaggctttgctgaagttgcttatcagcttcaagagtttttgggctgagatgatggggttttctaaatatacaatcatgtcatctgcgaagacaatttgacttcctctcttgctatttgaataccccttatttctttctcttgcctgattgccctggccatacgttgaataggagtggtgagagaggacatccttgtcttgtgccagctttcaaagggaatgcttccagcttttgcccattcagtatgatattggctgtgggtttgtcataaatagctcttattattttgggatacgttccatcaatacctagtttatttagtgtttttagcatgaaagggtgttgaattttattgaaggccttttctgcatctattgagataattatgtggtttttctcattggttctctttatgtgatggattacgtttattgatttgtgtatgttgaaccagccttgcatcccagggatgaagccaacttgatcatggtggataagctttttgatgtgctgctggattcagtttgccagtattttatttaggactttcacattgatgttcatcagggatattggcccgaaattttctatttgtgttgtgtctctgccagattttggtatcaggatgatgctggcctcataaaatgagttagggaggagtccctctttttctattgtttggaaaagtttcagaaggaatgctaccagctcctctttgtacctctggtagaattcggctgtgaatccatctggtcctgggctttttttggttggtaggctattaattactgcctcaatttcagaacttgttattggtctattcagagcttcgacttcttcctggtttagtcttgggagggtaaatgtgtccaggaatttatccatttctttgagattttctagtttctttgcatagaagtgtttatagtattctctgatggtagtatgtatttctgtgggatcagtggtgatatcccctttatcattttttattgtgtctatttgattcttctctcttttcttctttattcatctggctagcggtctttatattttgttagtcttttcaaaaaaccagctcctggattcattgattttttttgaagggtttttcatgtctctatcttcttcagttctgctctgatcttatttatttcttgtcttcttctagcttttgaatttgtttgttcttgcttttctagttcttttaattttgatattagggtgatgatttcagatatttcctgctttctcatgtgggcatttagtgctataaatttccctctaaacactgctttagctgtttcccagagattctggtacgttgtgtcttttttctcattggtttcaaatagcttatttatttctgccttaatttcgttatttacccagtagtcattcaggagtaggttgttcagtttccatttagttttgcagttttgagtgagtttcttaatcctgagttctaatttgatggcactttggtctgagagactgtttgttatgatttccattcttttgcatttgctgaggagtgttttacttccaattatatggtcaattttagaataagtgtgatgtggtgctgagaagaatgtatattctgttgatttggggtgaagagttctgtagatatctattaggtctgcttggtccagagctgagttccagtcctgaatatccttgttaattttctgtctcgttgatctgtctaatattgacagtggggtgttaaagtctcccactattattgtgtgggagtctaagtctctttgtatgttcctaaggacttgctttatgaatctgggtgctcttgtattggatgcatgcatatttaggatagttagctcttcttgttgcattgatccctttaacattatgtaatgcatttcttagtctttttgatctttgttggtttaaagtctgttttttcagagactgagattgcaacccctgcttttttgctttccatttgcttggtaaatattcctcctcccttttttttagcctatgtgtgtctttgcacatgagatgggtctcctgaatatagcacaccaatgggtcttgattctttttccaatttaccagtctatgtcttttaattgaggtatttagcccatttgcatttaaggttaatattgttatgtgtgaatttgatcctgtcattatgatgctagctggttattttgcacattagttgatgcagtttcttcacagtgtcaatggcctttacattttaatatatgtttgcagtggctggtaacggttttgtcttttccatatttagtgcttccttcaggagctcttgtaaggcaggcttttggtaacaaaatccctcaagcattggattgtctgtaaaggattttatttctccctcatttatgaagcttagtttggctggatatgaaattctaggttgacaattcttttctttaagaatgttgaatattggcccccactctcttctggcttgtagcgtttctgcagagagatccactgttagtctgatgggcttccctttgtgagtaacctgaggtttctctctggctgcccttaacattttttcctttatttcaaccttggtgaatctgacgattatgtgtcttggggttgctcttctcgaggagtatctcagagatgttctctctatttcctgagtttgaatgttggcctgccttgctaagttggggacattctcctggataatatcctgaagtgtgtttttcaacttcattcaatttttcccatcacctacaggtacgccaatcaaatgcaggtttggtcttgtcacatactcccatatttcttggaggctttgttggttccttttcattcttttttctctaatcttgtcttcttgctttatttcattaagttgatcttcaatctctgatatcctttcttctgcttgattgatttggctattgatacttgtgtgtgctccacgaagttctcacgctgtgtttttcagctctatcacgtcatttatgttcttctctaaactggttattcttgtttgcaagttcctgtaaccttatatcaaggttcttcacttccttgcattgggttagacatgcccctttagctcagaggagcttgttattacccaccttctgaagcctacttctgtcaattcgtcaaactcattctccatcaagttttgtttttttgctgacgaggagttgtgatcctttggaggagaagaggcattatggtttttggaatttttagcctttttgctctggtttttcctcacctttgtggatgtttctacttttggtctttgatgttggtgacctttagatggggtttttgtgtgggtgttcttttgttcatgttgatactattctttctgtttgttagttttccttctaacagtcatgccccttgctgcaggtctgttggagtttgctggaggtccactccagatcctgtttgctgggatatcaccagcagaggctgcagaacagcaaagattgctgcctgttccttcctctggaagcttcatcccagagagacacccgccagatgccagccagagctctcctgtatgaggtgtctgttgacccctgctgggagttgtctcccagtcaggaggcatgggggttggggactcacttgaggaggcagtctgtcccttagcagagctcaagcactgtgctgggagatctgctgctgtcttcagagctggcaggcaggaacatttaagtctgctgaagctgcagccacagctgcctcttcccccaggtgctctgtcccagggaaatgggagttttatctatcagcccctgactggggctgctgcctttctttcagagatgccctgcctagagaggaggaatatagagcggcagtctctctacagtggctttgccgtgctgcagtgggtcccgctcccagtttgaacttcctggtagctttgttcacactgtgagggaaaactgtatattcaagcctcagtaatgttagacgcccctcccccaaccaagcttgagcaactcaggtcaacttcagactgctgtgctggcagcaagaatttcaagccagtggaccttagcttgttggtctccatgggggtgggatctgctgagcaaaacaacttggctccttggcttcagccctctttccaggggagtgaatggttctgtcttactggcattccaggtgccaatgcggtacaaaaagacactcctgcagctagctcagtgtctgcccaaatggccacccagttttgtgcttgaaacccagggccctggtggtgtaggcatccgagggaatctcctggtttgcaggttgcgaagaccatgggaaaagcatagtatctgggccggagtgcgctgttcctcacggcacggtccctcacggctttccttggcaaggggagggagttccccaagcccttgcactttctgggtgaggcgaagccccactctgcttctgctcgcccttggtgggctgcatccactgtccgaccagtcccaatgagatgaagcaggtacctctgttgaaaatgcagaaatcacctgccttctgcagtggtctcgctgggagctgcagaccaaagctgtttgtatttggccatctttcctgggaatggtgtttttattttctaaaattgagatttctagattgaatatatatatcaaaaataatttccagaaaatctttattaattcatattttcactagatatgtatgagaacatcttttccactatacataaactatatatatctgttatcactgctttttcataatattaaatttttaagtggtctaatatgtctactttattttcttttaaaactcctgagtttccagtttaggttaagaagctgattatgttctctggtgcacaattttatatgtagacgcctatatagtcttacataaattttatttgttcacattcaagcctttaatccatttgaagcttgttaatgtttttgtttgctttacgtgaggggattacatttattttcttttatatggatagctagttatgccagtaaaatttatagataatccatcccttcttaaaggattaaaatatcaaccttgccatgttaaatggccatatatactggaatctatttcagttttctccattgtgttctaatgatctacttgcatattgatttgattaaagttaatttatagtattctctattgatgaagcaagtttcaacccatgtatttttcataagtttttggctatatttgtcatttaatcttcaattaattttaagatcattttacccaattatgaaggagcaacattgttgggattctaattggaattgcattgatttcagagattatcttttgttttactgatagttctataatatttactcaggacttgtttcaaattcttctgtaaatgcttatcattttcttcatataagttctttcactttttatttcaatttttatttttcgttattgtgaatgaaaaaaatttttcccactgttttttctaggttcttattttaaggataaagaacagcacttaatatttgcatatttatgtattattctggcaactcattaaattctacttctttctgtagagtacatttaggttttccagtaaacgatcctatactcatttttttcttctttttaatgtttatgccaattattagttgtctcaccttattgcagttgctagagtatccaagacaatagtcaaaataaacaagaaacacttgatgccttagttattgattttaattatattggttttagggtatgattgtttgagataatatttgtttggggtttttatagtatttattatatttaagtagttttattccttgccatcttatttagatactttactagagatggctgctgaactttattgaataactctttagcatttaaaaaaatttttaattttattttttttgggtacatagacgtgtgtatatttatgggatacataagatgttttgacacaggcatgcaatctgcaacaatcccatcatggaaaatggggtatcccaccaccacaagcatttatccccgtgttacaaaacataaaattataatattttagttgttttaaaatgtatgattaaattattgactatagtaaccctgttgtgctatcaaatactaggtcttatttattttttctaactattttgtttttgtacccattaaccatccccacctccccaccactccctatgcactaccctttccagccactggtaaccatccttctactctctgtgtccatgagttcaattgttttgatttttaggtttcttgaatcagtgagaatgtttgtttttctgtggctggcttatttgacttaacataatgacttccagtcccatccatgttgttgcaaatggcaggatttcattcttctttatgactgaagagtacttcactgtgtataagaaatgcattttctttatccattcatttgctgatggacacttaggttgcttccaaatcctggttattgtgaacagtgcttcaataaacatggaagtgcagaatctcttccacacagatttcccttctttgggtatatacccagcagtgggattactggattatatggtagctcaatttttagttttctgaggaacctccaaattgttctctatagtggttgtactagcttacatttccaccaacagtgtatgaggattcccttttcctcacatccttgccagcatttgttattgcctgtctttttgatgtaagccattttaactatggtgagatgatatctcgctgtagttttgactggcatttctctgatgatcaatgatgctagcaccttttgatatgcctgtttgccattttgtgtttttgttttgagaaatgtctgttcaaatcttttgcccattttaaaatcagattgttagattttttcctatggagttgtttgagcttcttatatattctgattatgaatcccttgtcagatgaatagcttgaaaatactttctgccattctgtggcttgtctcttcactttattgattgtatcctttgctgtgtggaagctgtttaacttgatatgatcacatttgtccctttttgatttggttggctgtgcttgtagggtataactcaagaaattttttgcccagaccaatatcctatagagtttcccgaatgttttcttgtagtaattttatagtttgaagtcttagatttaagtcttcaatccatttcaatttcatttttgtagatgtttagagataaggggtctagtttcattcttctggatatggatatccagtttcccagcacaatttattgaaaacaccgtcttttccctagtgtatgttcttggcatctctgttgaaaatgaattcactgtaggtgtgtaaatttatttctggattctctcttgtgttccgttggttcatgtgtctgtttttgtgccaggaccatgctattttggtgactatagctctatagtaaaacttgaaatcaggtaatgtgaatcctccagttttgttctttttggtcaggatagctttggctattctggatattttgtggtttcaataaattctaggatagtttttttctatttctgtgaagaaagacattgttattttggtagaaattgcattgaatctgtagattgctttgggtagtatggacattttaacaatatagattctttcaatccatgaacatagaatatattttcattttttgtgtcttctttaatttctttcatcaatgttttatagttttcattgcagaaatctttcacttctttgattaattcctagatattttattttatgtgtggcaattgtaaatggaatttttttatgtctttttcagattgttccctgttggcatatagaaatgctactgatttttgtatgttgattttgtatcctgcaacttcacggcatttgtttatcagttctaatagttttttgctggagtctttatgttttccaaatataagatcatatcatctacaaacaaagataatttgatttcttcctttccagtttggatgccctttattccttgctctaggtaggacttgctctaggtatgcttgctctaggtaggacttccagtaatatgttgaataacagtggtaaaagtgggcatccttgccaagttccagatcttagaggagagtcttttagttttttttttttttttttgattcagtatgatactagctgtggatctgtcatatatggcttttatcatgttgatgtttgttccttctatatccagttttttgagcgttttcatcatgaaaggatgtgagttttatcaaatgcttttgcaccatcaattgaaatgatcacgtggttattgttctttattttgttgatgcaatgtatgtatcatattgattgatttgtgaaccatccttgcatccctgggataaatccctcttggtcatgatggatgatctttttaatacattattaaattcagtttgctagtatgttattgaggttttttgcatcaatatttatcagagatactgacctgtagttttcttttctgatgtgtctttttctggttttggcatcagagtaatactggactcacagaaatgaattttgaagtattccttcctcttctattgttcaaaatagtttgagtaggattggtcttagttctcctttacatatttggtagaattcagtggtgaagctatcagtcctgggtttttctttactgggggactttttattacggctttgatctcatgacttgttataggtctgttcaggttttaaatttcttcctggttcaatctttgtatattgtgtgtatataggaatttttacatttcttctagattttccaatttattggcatatagttgctcatagtagctcctttgaatttctgcagtaacggttgtattgtcgcctttttcatctctgattttatttattttgatcttctcttttttgtggttagtctggctaaaagctggtcaattttgtttatcttttcaaaaaaaacacctaagtttttgtttcattggttttttaatggttttcttcatttcaaatgcatttatttattatcatgattatttcttttcttctactaattttgaatttggtttgctcttgcttttctagttctataagttgcatcattagattatttaaaaattttccaattttttggtgtaggcatctatagctgtaaacttccatttttagaactgcttttgctgtatcccataggttttggcatgttgtgtttcctttatcatttgttttaaaaaattcttcactttccaccttaatttcttcattgacccactggtcattcaggagcatattgtttaattttcatgtatttatatagcttcaaaaattcctcttattattggtttgtagttttatttcattgtgggcagagaagatccttgatattatttcattttttttatgttttcagacttgttttgtgacctaacatatggtctatccttgagaatgatccatgtgctgaggaaaagaaagtgtattttgcaacagttggataaatgttctgtaaatatctactagattcatttcgtctatagtggagattaagtcaaatgtttctttattgattttctgtctggaagttctgtccaatgctgaaagtgtggtgttgaagtctcctgctattattatattagggcctatctctctcttaaggtctatccatatttgtcttttatatccgagtgctctcatgttgggtgcatatataattttaattgttataacctcttgatgaattgacccctttaccattataaagtgacctcctttgtctcatcttataatttttttcttaaaatctatttggtctgatatatgtataaatacttttgctttttttgaattccattggcatggaatatgttttttcatccctttattttcaggttatgtgtgtctttatgggtgacatgtgtttcttgtaggcaacagatcattgggtcttgttttttcatttattcagccaccctatgtcttttgattagagtttagtctatttggagtcaatgttataattgataaggacttactcttgccattttgttaattgttttctctgtgtgtgtgtgtgtgtgtgtgtgtgtgtgtgtgtgtgtatgtgtgtggtctactcattcttctttctttccttgctgtcttctttttagtgaaggtgatattctttggtggtatactttagtttcttgctttttattttttgtgtatccattgtgtattttattttttgtgtatccattgtgtgtttcttggtttgaggtgtctatctttttttaaaaattagaaaaaaaattctttatttcttctaaaaaaaaccccaaacaaacaaaaaagggatacatgtgcagaatgtgcaggtttgttacatagctttatgtgtgccatggtggtttgctgcacctattgacccgtcctttaagttccctctcctcacccccaacccctaacaggccctggtgtgtgtcattcccttctctgtgtccatgaaaaacactatgttataacccatttttaaaagctgataacaacaccatttgcataaacaaacaaagaagcagagagaaaactaatactctccacctttactttgtccccctgctttttaactttttgtggcttctccttatatcttattgtactatgtcttgaaaatctgttgtaattattatttttggttggttcattgtttcacctttctacttaagataggagtagtttacataccacagctgcaatgttataacatctgtgtttttctgtatacttaccagtgagtttggcaccttcagataatctcttattcctcattaacattcttttcttttgttttgaagtatgcccttcaccatttctcaagggacaggtctggtgttgatgaaatatctcagcttttgtttgtctgggaaagtcttttttatttgttctccatgtttgaaggatattttcacgtgatgtgcaagtctaggttaaaagtttttcttcttcaccactttaaatatgtcatgccactctcccccggcctgtaaggtttccactgaaaattctgttgccagatgtattggagctccattgtatgttcttttcttcctcttttcttgctgcttttaggatcctttatctttgacctttgggagtttgattattaaatgccttgaggtagtcttctttgggttaaatctgcttggtgttttataaccttcttgtacttggatattgctatcttcctctgggtttgagaagttttctgctgtgaattttctacccttatctctttctcttttgcttctttaaggccaataactactagacttgcccttttgtggctttctagttcctgtaggtgtgctttattgctctgtattcttttttctgttatctcctctgactttttattttcaaatagcctgtctttaagctcactacttctatcttctgcttgatcattctgctattaaaagactctgatgtattcttcaatatgccaattgtatttttcagcttgagaatttctgcttgattctttttaattatttcaatctcctgttaaatttatctgatagaattctgaatttcttctctgtgttatcttgaatttctttgagttttgttaacacagctattttgaattctctgcacaaaagggcatatatctctgtttctccagggttggtcccttatgccttaattagtttatctggtgagaaaatgttttcctggatcattttaatacttgtagacattcatctgtgtctgggcttgaagagttaggtatttattgttgttttctcagtctcggcttgtttgttcccatcctgcttgggaaggctttccagctattctaaaggacttgggtgttgtgactgaagctgttatctccttgaggggttattccaagcccagtgacaatgtggttcttccagactcatagaagtactgctttaatggtcttgaacaagatctgagagaattctctggattaccagttagagactcttgttctcttcccttactttctaccaaacaaatgaagtctctctctcttttctgatccacctgcagctggcggttgagtgacacaagcaccactgtggccgccacctctaggactgtgctgagtcagacctgatgccagcacaccactgggtctcacccaacgccatctgtaactactccctggctaccacttatgtttgctcaaggctctggtgctctataatcagcaggtggcaaagcccaggcctgtgtccttctcttcagggcagtgagattcctcaggctctgggtgggtccagagatgccatctgggagccaggggagagtcaaaaaccttagatgactacctggtgttctattggactgcagctgacctggtactctagccacaaaatgcagtctttctcactcttccctcccctttccaaaggcagaggagcctcactccatggccgccaccactacagtcccaaggggagtgctgtcagactatcaccaatgttcccttaaggcccaagggctcttaagtcagcttgtggtgaatgctacctggcctggaactcacccttcagggacttgggctcccctttggcccagggtatgtccagaaatgccattccagaaccatgtcctggaatcagggaccccaagaatccactaggtattcctccctgctgtgactgaactgatatctgaagtcagcatgtctcagagtctcatttgaggccctcaatgtagcacctgggtattgctgctggttattcagggcccaagggctcttcagttaacaggtgatgaagcctgccaagactagatctttcccttcaaggcagcacattaccttctgtcccagggtgtgtgcagaaatgtcacctataagctaggaactgggaagaaagcctcgtgactctgaccagtgcccgatcctactgtggctgagctggtatccaagatgcaagacaaaatcctccccactcttccctctgctctcttcaagcaaaaaaaagtggtcccttttggagccatgagctatgcaccctggcgttaggggaggggggatgccagcagtctcttggctgcccttgctaatgtctcagaaggtcatagaccctcccagtccactgtctctgggcccagttcatcactaggattcgcctaggagttgctgtccttgtggcctagactgcctttcaagtttatttgagactccaaagcacattagcctgtgatgggatcacaaattccaaccactgagattggcgattcccttctggctaaggttggtttaaatgctccctccatgagctggtatcagctgagtttggtctggtttttgtttctgctataacaggccagtgctgagttcagtgccttacaattgctgagttcttctgctctgaacgcacaaaaatgctctctgcaccatgttgccactgctggaggatgggagaggggtggcattggtgattcaagactatttttcctgccacttcactgcctctttcagccaaatgtgcttaaaaccaggtaccgtgaatgctcacctgatttttggttcctttgaaggtgttttttgggtgcaaatagttgttaaactcgtgtgtttgcagggggaatgatcagtggagtcttctattctgccatcttactctgcctattttagtatttgttgtacgagtttttcaattctttttgggtcattattaaaacttgtattttgttagaagatcatcaattttttctctaggttttcaaatttgttgtgctggaattgtgtattaaattctctttagaaaagaattgtaatatgttaaacttttatgtatctgtaatgatgtttcacttatgactctaatttgtatttttactctcttttctttatctcatgagaccattaactattttattgatttttaaaaaaggtttatctttgtgtattatatataatatagtttttgctttccaattcactacttcagctttatctttattaaacattcctaccttttaggcttatcatatcattcttttccaaatattttaaatgagaaataatcatatattttcataattcttttttaatatctatgacatttaagcctgtatattttcttctaagtaaagaggcttctgcatcccatatgttctaattaaagaagtgctttctttttagttcattggagataggttttaatttcaattttgattgcctctatgatgtaagtgtcatttaaggttgtattttctagtttccatgtagtgaagatgttttttggttttttggggctttttttttggtcaactttttataatttctttctagtttgttggattatgacagaaaatgtagcttgaatgtagaaccttttgaatgtgttaagttttgatttttggatgaatacatgatttttaaaaatgttcaatgggcaagtgaaaaaagtgtctatttggggaagacaaggttctgtgaatgtttcacacagttaaattcaacataatttagtagtttacctttatccatggtggtgaatacattccaaaaaccccagaaagcacaggtacctatatacagtgtgtacccaaacctgtatatactatgatttttcctatacatatgtacatatgataaacttgcatgttttcacttaaagaaacactttatggcttttctttggcatatcaaaattgctggcatcactacgcttgcactttgggaccactattaagtaaagtaatagttacttgaacacaagcactgcaaaagtccatctgataatccagacgtctactaagtgactatcaggagggtagtgtatacggtttggatatgctggacaaagggacaattcacattccaggctggatggagtaggacaatacaggattctatcatgctactcagaattgcatgtaatttaaaacttatgaattgtttgtttctggaattttccacttaatattttcagaccatggttgactgtgggttactgaaggcaaaatcatggataagagggaactactgtattatattctattgttaacatatatttgcctgattcaatatgtccacctctgaaagagatatattgatctctcttaccataatcaaacttttaatcaatttcttctttaatcaatcatatcttcaatcaatttatagcaaacttttgcataataaatttgtcttttctgatgtaaagaactatatgactaatatcttttctgtaaattccattttttattttaataaatcatgccctttactatgcttaatgcttttatatttaaaggctactttctattgttttaataatgttactgttacttattgtggcattgtcctgatagcctctttcccagttttaaaattttcattatttcattattactttaagaatgttttctgtagaaggcacgctcgtcagatttttttgaaaaaaattacagtccatgagtctcagtcttttaatgcaaaaagtcacttcattcacacttaattcagtgactgatatgtttgatttcattgtaatcatctttatttttaaaatttattttatgttattttctcttttttagtttcctcatttttcctggtttgaaaaagttaatataaattttgggatcttcaacgcttaggctctgtttaaagtcatcagacaggatgagatgacccagaagtgagggagggtgataagagatctgaggactgagtcctcaggttcttcaatatttaaaggtcttaaaaattatagagaattaaccaagaagactataagcaatagtcattgatgtaagaggcttttcaaaagagagactattgcccaggagaccaagtaaagtgtttcaagaagaagagagtgataattatgttaaaatggtgctaataggtcaaaaaagattaggactgaaaattggatttaacaatatggtaaccattcatgactttgacacattttggtggagtagtgggggcaaaatcctaatgatttaaattgttgaagagaatgttagagggacttttgattacagagctgtgaagattttggtggcaaattataagtataaaactggacaaaatagtcaaaggcaaacatctcagggcactggaaattgagcaaaggctaacaacaaattgagaaatgtttattcttgaaaaactgcaagagcttttagtaagaacagtgaagatattatggtatccttgcctgaggaagttctcattatcctcacttccccaccaatttctgtggtcagcaagaatgatatatattttaccatttggtgacttctcatgaagaacagaaaatttgttgtcagaaagcaggacttaattgtgagtggtaaaaattcaatggcttttctgactaaaaattgtgtactaggttaggaaaagtgaaagaaacccagttttgctaactgaggtcactgtcccagttaaggtgagcaacagacaagtcagaaatttaatagaaagatattggcaataagaaagggatagaagggcaaatgtagctctccatatatccctggttgaaagaaaaagtacacatgatcgggaaagtctcaagagggcccaccaaaaaatgaaagtcaaaggagacttgataattgactataaatttgaatacactactgaacccacaaacagattgattagcattgggtaggtgtctttcaggctcaagatgtttgaaaaaaacttccgcccactaagttacgcaggtaaaggtgtgacttttggaagctatacactaaatagaaagctatacacacacacacacacacacaaaaaaaaaaaaaaaaaaaaaatcagagacattaatggctgcagtcaggcagatagagtttatagttgaagtcccggcaagttactaaaagaaaacaaatcatctgagaaaaaaatttaaaaagaatataaagttgccacattatttaaatatccaattgcaaaatacaatcatttcttcccaatagcccccaaaagtcttaactcagtccaacatcaactcaaaagtccaaagtccaaagtctcatctgagacttgaggcaagtttcttacagctctgagcctgtaaaattgaaaacacgttatttatttctaagatagaatggtggtacaggcagtgagtaaatattcctattccaaagggagaaattgggcaaaagaaaggggtaataggccctatgcaagtctaaaacccagcagggcagacattaaacctcaaagttctaaaataatccttgactccgtgtacctcaccctgggcacactggtacaagaagtgggccctggccgggtgcggtggctcatgcctgtaatcccagcactttgggaggctgaggtaggcggagtgcctgaggtcaggagttcaagaccagcctggctaacaaggtgaaatcccatctctactaaaaatacaaaaattagccaggtgtggtggtgcacacttgtagtcccagcaactcgggaggctgaggcagtaggatcgcttgaacccaggaggcagaagttgcagtgagccgagatcacgccactgcattccagcctgggagatagagcaagactccatctcaaaaaaaatatataagaagtgggccccaagcctcgggcagccttgccccgtggctttgcttattcaaatgctaatctcatccagaaacaccctaataaacacacctagaaataggttttaatccgggcactccatgatccagtcaagtaatcagataaagtaaaccatcatggaatgcctaaaggaaataaaacgaaaggaaaggacactagacagtatctccaatttatatgaagaaatacaggctggatgcagtggctcatacctgtaatcccagcactttgggaggccaaggcagtaggatcacttgaagccaggagttcaaggccagcctgggcaacaaggtgagactcgatctctacaaaaaatttaaaagttagcctggtctggtggcacacacctgtggtcacagctactagggaggctgagatgagagcatcacttgatcctaaggggtcaaggctgcagtgagtcatgatggcactactgcaatccagcctgggtaacagaacaagtccctgtctctaaaaaattaaaagaaaaagaaaaggttttggttttccaagcttggatttcctttcctatatcacagcccactaagtgtgcaggcttcactcatcgcttatttcattgccctgtgagaaccatggtttaggcagctggtgcaagaaaatgatgataatctggctactgccattgctgtggaaataaaccttccttatgtctgaccagaaacctcagatcctctgccatgagaaactatggcaaattaacctgttaatttgcaaatagcatgacatctcatgctcttcacagtttttaacagtgttaatcagataataaggaagatattatcttacaggatataaacgaagtctacaatgtatggtaagtataagtaatgagtgagcatgtagctgtgagatgtaggcagaattcttaagatgtgttaatgatagggaataagtttgtaagatgttacagataagtagacctgttaaagacaaaataaatggatatatgatggatcaaacaagagtgttactttcaggtagaaaggaatggaaagagcacatcataagatgccatcgtaccccacttggattaacaactatgccacccccaaattggccattcattggtaacaccaagtatactttctttctggtcccacaagtgatgtgcttaagaagaaaagataacgttatagttgtttatcaagttaattggtgacctacagccattgaccaagcacacttacttctgcatctttcctatttaaataaagccagaaatgccttctgtttgttcctcagaatctccccctttactcaaacctcatctctggtcctcataactgcaccgtcagtggggtaagttgatgcaaccgagagacaggacatacaaacattgtgtaacccaggatttgggtagtgtgttctgtccacccacttgcatcctacccaaagtgtgttgacatgtcagatttctttccctgttgcttcttttgtgtgttttaaattgatttactagatcatttgatgtaaaaaattgtaattttcctgtaagcttttctgttctgtgatctcttggagagtttgcctggtgttgtgcttggtagacagcactgcatcacggtaatttcttacataaggatagtgggagccggtgaaaattatcttctgattacttcaattttgctaatttattaggatgtaggtgatcagctgagagtgaagaaaaggaggagatggaattttgagaaaagtggaaaaatgaaataatcatctgggagaaacataaactaatttgatagggaaatgtagtcgaattattgggaagcagtagggacccacttgaggttagtggtcatgaatttaagtgaaacctgttaccacagtcttgtgttttcctctgaccacattcaaactgtataggtacaaggagaaagttggtagagttgtatttattcaagattgaggtttttccctgagggtgtgataaggaatgagggtggcaatggactgagtatataagctccatgaaggaagaactgtttctcaatgcttagaacagtgacacagtaaatatttaataaatatttgctgaataaatggaaacctgatagatttttctctttatcctcaaagctcagtaattttacaagtatgtcttgtctcaccaattctggctggaatttggtgatcccttttagtctgagcttagctacttcttcagctcagggaaattttcttctactaatttgcttgattgttgtctctcttccatctgttcttgacatccttctggaactcttctttgcattttaaatgtcctaagtctatcttctagggctcttaccctttccctcataatttctttcacttcatatttctgctttgagttggaagtatttgttcttttgattttccagtttcctagtttgggtctcaataaacattgtcctctacttaaatgtgtctacttagctgttttgttgacaaattacccaatgggtgtttgttttgttttgttttcatgggcatgtgctctacttgttctgagtggtttctctccctgatttccgggtcctttcaacctttcaatttattgttttcctttgtcatccactgtcagctgattaggaccaagacacatttgttggagttctctatgtgatgggagtcccacaagtgttaaaaggtgacatggtgtctgtcatttcgagctaatggttttaaagcaggcagattgtcagtagtgcacatttttggtctccttgtacattcccggcctggcctcagagtctgggaagactcacctactattttagctgtttcctggcctcttacaaaccagggggatcagccacactcaaacaaggggtcaacttttgtctctttttccctgccccaaccagaaggctcacagatctctgtaggccaagctctgtctagagtccactgctgactgatcctctcatttctgatgctattcttcagaaatctttttaaaaagtattttactctcataaccttgttaatgaccccaagaaagaatcctatattttcaaaaacttcttggagtaatcttactctgctttgactagtgtctttaggtctattgaacacttagatgttccacttttaatgtatagttctacctcacttaaagccagaccaatttgtgaagatatggagtaatgttaaagacaaatttgggagtaactctgcttcatcaaacttctcaaaacagtgttgcctcaattaagctcctatttttttctctgaaagcaatttcatttgaggaaatttaagttatgtatacattttgaggaacatatcatctactgaaagtcagaaatttcaatgtaattttgcacctgttaatgagtttactaattattctcgagccacagaataaaaatgtattgtgtatctagtccataaaatattaacattaggaaatgacttctcaatcttttttatcctctccacagtgcttaatactgtgtttttgtacaatgaagattttcaataaatgtttaattacctggatggaggttaagttcaaattgtagcaattatccggataatgttacaaatgcaaaacattataaaatgaattgtaactatactacgatggtcacaaagtttctccattctttcaatccctggcctgattaagagtttgttgttggaagtaagaaaaaagtatgagtagaaaattggtgacatctggaaatgtcagctgaagcatacatttctcaccattcttacctagtgattctacttttcttgtgtctttcttcttcaatgtattctttaccccatatattttcctggggtctttgtaatctttttctaaaaatccaaatagtcatatgcatattcactagcaaatcaaaaacagaccaattattgcattcattaaatcactacaagggaagtatatgttttattggtctctctattattggagaattttaaatagtgtcgatttgtcttaacctctttagttaggggtgattgctattttacctttgaataagaaataataaaatgtaataatttggagaaaaatatgtttagttcttacaggtgttgagggggaaattcttagtccagaagcaaatttatatgcagaattgaaatacgtcatatgtactgtgtttcagcagagtaaaaataaaaatccacattaaaagaaggaaattctatcatacgccacaacatgtatgaacctgaaggatattatgctaactaaaataagcttgatacagaaagataaatctcgtatgatctcacttatatgaggtatgtaaagtagtgaaactcatagaaacagaaagtagaatggtgattgccagtagctgaggggagggagaaatggggaattggtgttcgctgaatatagagtttgagtcatgcaagatgaataggttctagagatctgctatacaacctgtgcttatagctaacattactctattgtatactgtaaagtttgttgagagggcagatctcgttttccgcctgccccccaaacttaaaaaacaatctatattaatttcagtcctcttctcctttcatggcctctggtctaaacaccttcatttttaaaatagaaatttggcatctactaactctacaatgtgtactaagtcattttgatattttaaaaattgtatttcttctgtttagttacagcaagagaaataaaatctgaaagtagctgctgaacctccacataatgtttgagatcaaaaattcattgataatccatgtttgtgattccagggccttttactgtctctaagaggtggaaacaaacgccaagcagccaatttgtttctaatggtatttgcctcattatagtagggtttgaggaaggtttgtttttcaaattcttcctacgtatgtttcactgagattggaatggctttaaaaatgtgaagcaagctgttaggtgactcattgtccttcatgttaaaagataatactgctaaaatagtttcttcctgcaacatgagttactggtaagcacattacaaagtctgtgttcctttcttaactgatctctctatgtgtcctttgctcaatacctacagttgctttaagaacttgtcactgatagtcgctagagttgtgctttataggagtctgaacttctagctcagtttgagacactctatttctaattgtgtatctgtgtgttttctgtctatgttggctgctttgttaaagttcataactcctaatgtagtattcattcaaaaatgtgttttcttgattctcagaaactgtatgtgggcatgaggaaaggatgaaatactctgaatcagtgaatggcttgccctttaccagactcagcttgctctgtcctgttttcattgttgtttgctttgttttgtttttttctttagtgaatacagtattgagttcacatgactgttcttccccacatgttgccctttggtcagatgtcttcatattatttattagctgagtctgcactcatattccctcaggaggacaatctgtttgtggagatatatgtgtgtcaggttgcccagataaaagggaatgtcattggccctgaaagcctgctgatttgtgtttgtttttctaaagtcagatagcatgagcagagtgttcttctctattgaccccctgctggtgtcactatttagagattaattcaacagccaaaatacgtgagttcacggagtcctttgaaacgtgactttcctgttccctgaaaaaatatatatatcttattgaattctcttgcataccaaatattattaaagataatgtgaccttacctccaagcattcttgcaaacagaaaacaaaaaaaacctaactatcctttcctcagggaaagtggtataataacagacacaaattactatgctttcagaacaaagctgtagcttggcagagtgttattaaagtgaaagaaagatggtagaaatggaaaggaaataaaacaatatctaacaccaatgcaaacccagctcaacaaagtgtaaaacacaaagagatgcaaatcatggtgctgaaatcaaccatggaggcattggcctcgataattggtactcttgctatttgatactctcagttgcaatttaaacaaattggtgtgctgaataagttgaatgcaacgtaagaccttcttgaccaccactcagaattgtgatttattttccttctcagccaaaatcaaagagattaaccatgtcacagactagctctctaatattaatgacttacagttattgaactctttcatgtgcttcttacatgctttgccacaattataatcataattgtatttatgtaagtaattatgattatcatttaaaaattaatatttaatgttcaccatagctttatgaggtagatttattattatcatcattttatacaagaaaaagataagactgagtagctgaagaacttgcctaatgtcataaaactagtaaagggagaagtctgaatttgaaagcagcattgactccaaggcccacatgctgaactgctacctagtactgcttctctgcccctttttatcatcaccaataatctcttttttaagtaagacaaaacatatccagatttgtatccacctctctgctccacggtgggcctataattattttgtacagagtggaacagtcaagcttttgttggatatctgaggcaaaatggaaaaatagattaggataaaggcatagaagtgatgtcctaatcacgttcatggtctgtttggaataaggagtttgaaataagtccagacagaggattaattccagaagagaagatctagagtgaacaggggcaacggggtggtcaggtatttttcatatcacacagatattaaagatcagagtgaacaacaagtttgggacctagagaaaggacttaggcatcaattatgaagtcagaaacccagacgaacaccctgcaccacaaaagatcaggattaaagcaaaggatctgaacgctatatatgaggtaataacagcattaaggatcttgatatggaaccaaccttctgtctcatgtttggagcttgcagaggcttcctgttaaaatagccaagcactaagtttggttagtcagggaatgcaaatgaagagatccatcattttttgtcaagactggaaaataagaagtctgaaactttccgtctccttaaaaaaatctgctttcagtgaaagagccgatatcagtctttttagtgtgaataaggtaagctatgtgttgtctctcctgggagattttacattttcagccttgtcttccaatgtagaacgaaaatcttaatcctggtttataggggtttccagctcaagcctcaatatggaagtagatttacagaaaggagcagaagttcttccccatactcttgataccaaactactttgcttatgctttggaattgccctgccaatcttgatcatttagtcagtgagaatgcatgaaagacttacatattttggtgacttatttcatttctatttgtaagtctttgtgcttctatctataataatcagtgtagctattttaaaaattagaagacagtaaaacgaagttgacctttttagttaatgcagcttaatagagcccagcagtttcattggtaagtttcctgtcttagctggtgttcataattaaggtgattcagaattgttagataactgcaattttcttatctgttgtaattcttagaagtcagtggaagagaaacaaggagaaattgaagtttatacttgtgtggtgaaattgcaagagcactactctcagttggtaattcatcccctgaacctgaaagaggctgtattcagggataaaacagacatgttctctcatctgtctatctttaggaatgatgaggtcagtgtgaatgagtaagaagatagacacaaccagttaagacgttctatactgttctagaatactgtagaatactgggtaatgtactgtaagggtttacatccagatggagttaaatgactcaaggggacagaatatgctagtagctatgttaacttgtttctgtacttgactgatatacttagaaaaatcaacatgtactcaaaaccagggcttaaatgaaatacccaaatatttttatgtgagttttgctttctcactgtgtaaactcgggccagctacttaagctcaagaaatttcagtttcatccttataaaatggtgataataacctagttcttcattaggttattgtgagaaataaatgagataatatacataaatcactcaacacagagtctggcacatagcagacattaaataatagaatctattattatccctttatgttgttaaagcaaccctgtttagtaggaagagaagctattgataatcatataacaaatatagaaaatgagtcttaggggttaaactatttgttccaagttgttagtagaacaattaggtccataattcatgaatgtgtattattcttactttcagagtttaactcttgatgtatttaattctattcttgatttacaaattttaaatgtattttatttggaatttaattctcctatgtgtgtatgatttatctttgcacagaattagaataggatgccaaaaagtgaggacatagagtagtgccaagaaatactagaatcacagtagctccaggggatggccgggttcagggaagaagtaacttggatttctagaatatgaagaatttgaagaatttcagaaagtaaacagtgaacagaaagcaaaggaaaacagaaacagaaagcaaaggagccagtgaaaaggcctaaagaggtaaagcagggatcagaagctcaaacgtcttcagagtatgggcaggtagctggctgaagccagtgaatgtaacacagtagaaaagaatcagggctgagacaaagtcaagagcgtgtcccagctaaatgtattacaaagaaaaaaagaaacacctctgaagatcaaacaatccaagtctgtgggctaatttcaaaccttaagctaatgatgcctggaataaatgacagggcaaggtgtcagaggaaatgggatgagatgggatcaaaagcgaagatgaagtaattaacaaagggagaaggaaatatctttcttgggcttgcacagaagttgggaaaatatggtgctagataatttgatgtggaaaggagaaagatgcagaagttcatgcccctcaatctcaggaaagtagaaaaggagagatatctcttaggagtgcttttgaagacagaacagaaactgcgggcttgggaatttgaagaagatctgcctagaaaaatcaccataagaaacacaatagaaagtcgctaaaaagaaataaaaggactactcactagcagaggaggaacagctgaggttagacagcatgggtgtgaactggtcccattcaatacagtttcaggattttttttctaagcatacaccaaaactgtttctattctgcttttcatcactctcatttatagtgtgtttgagtaatacaaactcacattattaatctatgccaaatgtgattgcacatgaataacaacaacaaaaatgtcatattaccttaaatattataaaaatgacttttgttttccttatgccgctggtcctcactatgaatgtagaagatcaagacttaaacaaatagtactttatttatcttaatgttcaattgattttcccttaggagtagtgtgtgtgtgtgtgtgtgtgtgtgtgtgtgtgtgtgtgtggtgtgggagaattatgcattcctttgtgaatgttctcttagtcccaggatatcagaaagagggacgtgattctcagacagagtatgtggcacaggtcaatgtgaatgacaccactgtcagtttgacatgcagaacaatatttttgtaggcctacatagtgtttaaaaatttctgcagtgtttatctcatggactatgtttttgctaccttaagatgtgagtctgttttaacatttctcatagagaagaaagtgcattgcaacttcttttttttctaatatggtatggggaaaattgaggagctggaagaagtatttcctgaatatgacatcagtgaaatctgcacatttcttccaccagcaaacagtttcaaaccctagaaatgtgctaggtacgattaggcctttcaaatgtaatgagaaatgttttgtgacaatttcttgcaatacagtagcaagaggtagagaagaaccacatcaactgaggggctctggggtttagagacatccttcaaagtggagaaaaggagggaatggagcttgtggatccctagccattcttgagtggcctgtagatgaaaagtggtctactgaagacaacttctgctcagagggctaggcagtgtgccgcagggcaagaaagaggaagtgaacagagagaccattatgccaatgaattaacttagtaaaagatggaaggaagggaagatttttatcagtttttatgctaaggaactttgaggagagaggaatatgcatacatcacatttctgttaaggtctttgtatgcagcgttgtgtaaatcttccagggcggcctgcgccttcaagaatttatcattcttttggatgcaactccattcatagattgggccatgtaaggccctgtcatttattagggctacacagaggcacaaaaaagttatgtccttcatcctaaggaaacaacagtaattgccgaatactgaagtacaaaattagatcttactgcacaacttggaaagaagtagaaattgatgggaactcttttttcgggtccatagcttttgcaccctgagccttcagataaagaacaaaagcagaataactcagagactcctctccaagcttgaagcagaccctaatgcttatgttgaagaggcagctcatatggccggaagctgcttggctatcccctcacaactgatgttcaaatatattaatgaaagatactggctggagtgtacactggtctaattatccttcttttttttttctgtagccatctaattacattccatttaaaagaatgttttttaccatgccatgtatacccagtattcttaaaaatagctgatactttttggtaaaatcagtcaagagaaataaaattgtttactttcttatagccatcttttttttctcctttgaacattatactttcaaataaaagtatcggctgttaaaccctgtcaaaatctaaagcccatagcatttcttaatagcctctcaactttatccagatctctgaagactgtctgtagactgaagtttctgtgattcaggtagaattcagactttacagaaaaactaacctttcagctaaaagcttgctagtgagtgtctatgtgtgtgtgtttttttcttcatgatttgagccaagtgcaaagacttacaaacttgttctgaacaggggaaaatatttcctttttcattccttaaaattatgcctttccatgtttttcactaagcaaaactctcccggttatctgctggcactagagggttaagttaaatagtgaggcagggagctgctataagatttttatagctgtattaaaatgagaaatggtaatgtggctaagcaatttctggtcaggtgatctcaaagatttatacatgtggttttaagatatcattcaccaatcacatcacactactaatcttgctcatttaataagcatgtctattttgttactttcattcagttgttgtctaatgaaataatgtgggtagtttgaaacaagcacagagaatacaaaattactcttctatgatgtgatctgatttggattcagagcaccactgagagacttatgtaaggtttcaaaaacagaaatctgtgcataccaagctttagcctagtggtttccaacatttttgtaatggcaacatcctgccagtaatttgattttgtgaaccttgcactccaatctgactggtatcaataacacacagtttaaaacaaagtaaattaaccacacatttcttttgaaaaaaattttactttgttggtaactattgagataatcagaagtgggaaattcatgttgaagtgttatagacaatggttgaaaataaccattatttatgatggacagtataaacataatatgccaactaacagaatacttttctttttccatcccccaaattttagcgtttcaattttaactggtttgctctaataaatttgtttacttctaggacaccaacaaatacgaattagaatatagaaagtcagtgattactatcacatctatttgtaacttcagtactttcacattttcattagcagtctgaatgctaagtaccacatttctatatttctctaaagccagtgattgcagtgtgcagcagaaaaatattaattattataaagcctaattaaaattgaaagcaaagctttaataagtataaataccattgtttatcaaatgtggaaaacacacattaattattattttgcaaaccctatccttagactcatatgtgtaactcccagatacaaagacaatagcattatgaggtggtgatgtgggtaggaatctaagctttagggacatcagtacgtctaaaggcagtcagcatattaggatttttgaggggacaaaaggctacttttttacacaagggttagtattttgataatgacaaaagaaaaatactgcatgtaaaaacatttgctctctatcttttttggtgactctaaatacagtaggacagggaagtaaaaagcagatagcaaaaagacagcttgtgaaatgcacacagtttgttatcagattgccagtagttgtgaagaatgggaaagtaaagggagggaagacagaaagaaaagaagatgtgagaaaataggatgctttccatttaaatgatgttttagcataaatcacacttctaaaccaaactgcagaaataattaatgaaactagtatcatttttcttgttttatgatatgagtttcgtatcaactgggtcaaatggtgctgttgagcagcaatagatcattgtgaaatctctcatggggcaggacaggaaatgctgaattgtttgagttgctcaaggtgcaaccaatacctagatttcccgtcttgtatgtaatgatacaaaatagatcctatatgcacaaattataagaaccagaggccaattaattcaagcaaaaatgtaactatgaataaatagggaccatcaagaaaggctgagttgaagacaatacattgaccaatagtcattggcatgaagtggatcaaattgttgaagtcaatatgtagtccagaggaggcccaagaggaaaacaatgatgtctttatgtgattagtggtacagcagcaaaaaagaagaatttatatgtcgacatttatgtatttcttataatctgaaggctgctatatcttgttctcttctcttctagccactactttataattgccaagcttcttgaaaataaaaaatgtgggagtaatggctcacatttgtaatcccagcactgttggaacccaaggcaggaggatctcttgaggccatgagttcgagaccagcctgggcaacatagcaagaccctgtctcctaaacaaatttttttaaacattaaaaaattaaaaaatttgtctacaatgattatctacatttctcgaactccaaacccatatcattctgatttcttcctacgttactatcctagatggccacaataatatcctaactgccaaatctattgaacatttatctgaatcaatctttgatatttgactttgttgaaaactacctccttctcaaagctctgtcttccaggacttctgttcaacctttcttcccatgttattccactgatgcctatgtgtagagcacctggcaaagtatttgtcacagagaagatgctaggtacgtgtcctctcctctcattccaccttccatttcaactttagtgtcctataggatcttgttgtcagtccttttgtcacttgctttccttgagcaaaataagaatttcacatgagcatgtcttttgtcattctctacactatttcttgttaaagaatttaaatttcctgtctttaccacatctctagtttattaacttaatttaaattatgaaccactatgacaaatagatttagctctgcttcttggagcctagttaattacccttcatttattatcatttactttttatttaggctctcaggttaaatatggataataacaacaccaccagttggatttttcaacatagtgaaaaatctagcaaactgattacattgattggtcaaggttctcaaagtgatcaagctagtagcctcctgcagagacacaatctcagtattttttttatttttaaaataccatggaacttaattgtatttcctgtattaaatgactgtctctcattttgtgccttttccctgtttagacagatgttatcattcccacccaacttttttttcaaattattgagtacttttttttttaatattattttttaacttttaagttcaggggtacaagtgcaggttttttttacataggtaaacttgtatcaaggggttttgttgtacagattattttatcactcaggtactaagcctagtaaccattagttatttttcccaatcctctccttcctcccaccctccaccctcaaaaggccgccgtgtgtgttgttctcctctatgtgtccatgcgttctcatcatatagcccccacttacaaatgcaagcatgtggtatttggttttctgttcctgaattaatttgctaagggtaatggcctctagttccatctgtgtccacgcaaaggacatgatcttgttcctttttcatggttgcatagtattccatgtgtatatgtaccacatttgctttatccaatctatcattgataggctaggtggattcctcgtgcttgttattgtgaatagtggtacaatgaacatacacatgcatgtgtctttgtaatacagtgatttatattcctttgggtatatatctagtaatggcattgctgatgtgaatgatatttctgttttcaggtctttgaggaattgccacactgtcttccacaatcgttgaactaagctacactcccaccaatagtgtataagcattcccttttctccatagctttgccagtatctgttattttttgacttcttaatcatagccattctgactggtgtgagatggtgtcttattgtggtttttatttgcatttctataatgatcagtgatgttgaactattcttcatatgttttttggccgcatgtatgtcttcttttgaaaaaatgtatgttcatgtcctttgcccacttttttgtggggttttttttcttgtcaatttgtttaagttccttataaatgctgaatattagacctttgtcagatgcatagtttgcaaaaattttctcccattctgtaggttgttgctagtttctttttctgtgcagaagctctttaatttggtctcatttgtcaatttttgcttttgctgcaattgcttttggagtctttatcatgaaatctttgtccatgcctatgtactgaatggtattgcctaggttgtcttccagggtttttatagtttgcatatggtataagaaaggggtccagttacaattttctgcatatgactagccagttatcccagcattatttattgaataagggatcctttccctattgcttgtttttgtcaggtttgtcaaagatcagatagttgtaggtatgtggtctgtttttggggttctctattctgttctatttgtctatttgtctgtgtgtctgtttttgtatcagtaccatgctgttttggttactgtagccctgtagtatattttgaagttgggcagcatgatgcctccagcttcccaacccaactttttacttttcacacctactcagtatgttttcaattctattgggtaagtgagtcttttggatgtggcatattgtatgagatttggagttcagtaaaattgacttaaaacttcagtttcctcatttattaaatgatcctaacaatgttatatggtcttaagggctgaagtcattaacagctatctgttagcatcatgtcttccacatggaaaacaacctcaaagtttaatggtcctgtattttttgcctttgttcctcccacatagaggcaatatgctgtacacttcttttatgtaacatagagtcccaggttgtgtcaggaataaaactccactacctggaacaggaatggaaggaggccatgcaagtttattggggtttatgtatggaagacacttttactggggatagtaaaagagaaagggcaatgagataatgcttaggttggagtttgatggagttgagaatgaataatttgctaaaaaatagtgggacctagcataagtcaccatggtggggacagatgaaaagttcagcagcttgctgtttaaaatggaggaagagaccagatattatgttttgttacccaacttgacattggtcaggttatagtcaaacggacaaagctatatcatataaaatagtcatcagtataaaaggtatactctatttatttagctttcaaaattttatttctaataatttagaaatcatttatcagttggccagccttactatatgtgcttttgatgaaatcttgtaagttttccacattattttaggtttgaaaattagagtattgatcaaatcactagcttggatacaggtattttgacgtccctgggtctttaaagttgatttaatttaaggtgaactgctgttcgtatctcctctcccattctctgttatttatacagatatcctaaattaaaacagaagtggtacactgaatcccaaatgtcctagaaatgctgtatatgccacctgtaagcatctttgaatcatatcttaattttctgatggactcaggcctttgatcctattaagaattcagcactgagaccactcaggaagagccaaagtgctttctgttggggttcaggcatcatcaaccaaattgtcagctaagttctcattgcagaatctttattactggcaatgatgaaagaggcagaaagaacacagcttgaatctcagatctctggatgaaaattcagaccaggtattgaaaatattcttttaccttataaatgaagcaaatgtcgatatatctgtgattaattgaaattagaaaaccctgtaatgtcatagtttacttactttttcagcctgaaatccaactgtgactactgatcctagttcctgttctgtcatcatagcgccaactttcttaacaaaaggaacaatagaatcaaactagataacatggtttgaaatagaaaaagtcagcatcttcccccaaatcagtaaagtctgtaatgctgatcaaagatagagaataaatgatgtagcaatgagtgtgggaatcaaaggactatcaccaattgaaggcatttattggtaattaagatgaaggagcatgggttgattggaatttattataaaatgttcatggcagcaggattgctgtgaactaacatcatcaatattagagctattgctatgtctctatcataaggtagtgacagataattaataaacccaattaactatgaaattatgtctgcttaggtttttgcatatggcttgactatattttaaagtaatcaaagtgattttcaactgataaaaatacaccacaagacatctcttcttactgaaagatccattttcagtcaatttgagcgtaaaagttcttcagaagatggaataaatctatagactggtttggagattcttacccttgtttcattctcctcaccagcctacacagagagattggaagaaagcagacagacctttgtgaacatgacagcttattgctatcattacgtgctttctgttttctgaaaaaaaatttgtgaaagtaaaagaaaatatatatgtcttttctgtcactgagcttttaatcacagaagtcaaatatatggcacagaagagttgaaacattaactggaacaattttgataaatgcaattggattaaattgtacacaatataaggtagagatgtggatgtcatggtatgagaaagaacaaggaagaggccatatacattgaaagtacctcgacataaatatgtggacaattatttcttctttgattttctttttcttatccctcgaaacctttctcttttaatgtggaaatttttgtctatctctgtgtttcaagagcagcaggaggtagaacagtatgagagatatgtggaagggtcattgcatgaaaaaaaaagccaatctgagcatggaacacctactggggtcaaagagaataatgggatgtaattaaacggcttcctagggagatgaagcaagaagagcaacccacccaaagatacttttcctcatgtttgataatatagaacctctgcacatataaaagtaaatgctgttggtttatagaaagatctatatatgtgtaaacattttgatccactttcagaatggccactgattttcatctatggtggtttcattagcattccattttagatatactactttttagcttagagagtatacatgtttgcctgtgacaaaatccaattcccaacccccaaatgaataaacaaacaaacaaaataatccataaaaaatcaacgtgaagaagaatactctccaaagcctgcaaactaagtcattgtcttttatttattagcataatgaaaaaaattctcagtcgcttatggaagtacaagaataaaaatcagaaaaatcatgtgagtaattacacatagaaggaattcaaatccgtgctgtgttggagctagcaatggcttgtaaaagccaattgttaaattttcagtaattttgcaagctggttgacatcatgttggtagctgaaatcagtcatggtgagatggaaattggcaaatgctacaaatcagaactttctttgctacctgagaaagccaatttttaaacatttatttgtgtatcaccagattcaatcaaatcaatgcaatttttttttttttttttgcaaatctcttcagctagttttcccctaggttaatagcatgacatagaatggtgcttttcaaatctctctcttttttaacacaaggaaagttttccaagcaaaatcttacatggaaacttatataaccaataaagacagatatgctcttattgaagtaaataggggaagagtcattccctggcgtccctccgtcctataagctaccaaccaaatgatcctctgaaaccccacctggactctggaagccatatttataacaattgataaaaaggaaagaacaaaagctggaaaacaaagacacaaggaattatggtcccagttttgactataagcaaccacttcagaccttgatttcttttttgtaaagtgaagagtttagacaaaggacattagaactctccaagctataaaactttgtgtttctctaatttaaagattcatgagtgttccgtgaaaataatttttaaaatttgacttaaaattaaagataaattctacttcaggtcagcactctcatattttttcctctaacttctagggaaattatttttgcatttaaattaatttgcaattgccacatacttgcagctagactcacaaaagtgataatcttgccaatgcctatacaaagctgctaacatttttaccaacaaatattctcattatattggtgtagacctagccaaacaagacaaataatccttcttcacatccatatttgctctatgcagtgctggcagcaccaatcttggttgtttactgacttctttttatgcattaccatacactaaattctcctacttctacaccctgtccttgatgatactctcttcagaggcaatatgagtcatattagtaaaagaagagctgaacggttctggagtgggtttccattgctagagtatttggaggtggtgaaaacaaaatctgcaaagtaagataagtttgcctcagcagaagcaattctgaaagccgaaacaggtatgttatatgtgggtatgtaaatgcataggtatatgtatgtattgataggctcataatttcccaaaagaactatttcaaaataaagcaataatatgtctacccatctttcaactatctaggcatagattaataagtatgtggaccaactaaaataaaaatatataacagcatatttataaaaattattactataaatcaattaaaacagctacatgtaaggatctattgttcagaactagaaagtaactgttagggtcttggcaggtgctatggtctgaatgtttgcaaccttcaaaattaatatattgaaattctaatccacaaggtgatagtattacatggcggggcctctgggaggttattagatcatgagggcagagctctcatgattgagattagtgcccttaaaaaaaagactgccggctgggtgcggtggctcacacctgtaatcccagcactttgggaggccaaggctggtggatcacctgaggtcaggagttcaagaccattgagaccagcctgaccaacatggtgaaaccctgtctctactaaaaatacaaaaaaaattatttgggtgtggtggcgggcacctgtaatcccagctactcaggaggctgaggcaggagaatggcttgaacccaggaggcagaggttgcagtgagccaagatcacgccattgtactccagcctgggtgacacagcaagactctgtctcaaaaaaaaaaaaaaaaaaaaaagactgccaagggctaggtagccccttccaccttgtgaggacagagtaggaagattccattatgagaaagcaggtctttacctgacattgaaactgctggtgacttgaccttggattttttagcttccagaaccctgagaaaaaaacttctgttgtttttaagcctccaagtttgtgggactttgttatagtagcccacatagactaagaaagcagtaataatagtacacttatagaaggtgtttgaagagattttaaataaaaaggctatttttaaatgtctgggcagcattaagggaaagcaacaaaaagcggtgaagcactcagggctaatgacagagagcagcttttatcaacccatggcctaactggataggagaagggaaatattaccagatcctggagaggtaatcattccctggcctccctccatcctataagctaccaaccaaatgatcctctgaaaccccaactggactctggaagccatatttataacaactgataaaaaggaaagaacaaaagctacaataagagaaggccatctgctgcgagctgtaatatttggaagaggggtgtagctgccagttaactctttgggaggaagttattataataaataccctgacctctttctcctctgaccctctaatcccttattggtgcctcccattggctaaaaccaaccaaaaccaagaaagcctgttgacccacacataaagccaacttcctggggcacagaaaaaggtgaaaatggtagagagaggaataggcaaggaaaattgagaatatccaccacagtaaccaatagcttctacttttggtctactggaatgtaacaataccctttcatctttattaattaattcattaatccaatctatatttagcacttactctataccagacactgttcacagttttaattttacagcagtgaacaaaataaagattttgtcctcaggaaaaaaaagagacaagaaaaaataagtaaatagtcaaaacaagttcagataatgttaatactaaaaaataaaatgaagaagcatgatagaattatcacagtgggggtatggagcttctccaggtaatgtgggtaagaaaggcctattggaggaggtgataattgaactatgatatcatgatgagaagacatgaagtatgctcataactgaggaaagagaattctagacaaagggaacagtgactttaagggccatgaagcaggaacaaggttttcatattagaagaagaaaaagagagtaagcctggttagaatacagacaacttagtagaacacagagaacttagtagaacacagagaacttaaatgagtctggagtataggggaaaggcatcatgagggatgtttccattatgtatggctgcacatgtagctactacaaacataatagcttaatataacaatttattattcttcaggtgttcatgagccaggaatttgggcagaccctggttcaataatttttctgctctgtatggtgttagctgaagacatttgatagtgttcatctggtggctggactgggctggattgtcaaagaaggctctagaatccctggtgtataggtgcttctcttcatggcctctatctattcccatgactactttcagcttcctcagagcatggtggtctcagggtagtcagacttacatggaagttggcttcctctcaggaagaagcagaatctgctagacctcttgtgatctaagtttgaaagtcccagaacgttacttctgttgcatcttatcagtcaaaacaatttacagggcgaactcaatttcaagcagagggaaatagactctagctcttgattgattgttgcaatctttggaaaccagctatcataaagtctcttgtaggccatagtaatggtttggattataatccaagtacggtgaaaagccataggaagttttaatcaagggagcaatattattttatttagcctttaaaagtaacactctggcatctgtggagaatggaccctagtgttgcaagagtacaatttgaaagagcagttaggagtctcctgtggcagacaacaagaaaaattatgatggcttttaccaggatagtgttggtagatgtagtgaaatatggatagatttggaatatatttgagaagtagagctaagaagacttgctgatggatttaatgtgtgaagtgagagaaaaagaagacttggagggactctgaagactccaagttttttatctgaaagcagagatcatggtgccatccagagaaatgaggaagtttggggaaaaggtggagggaaggagagcaaattaaaggttttcttttgccaactgtagagctgagtggtagacatactgagttatttaaaaggtctcctactgtccctaccaacaactactgtattagtccgttctcacactgctatgaggaaatacctgagactgtgttaatttataaagtaaatgggtttagttgactcacagttctgtatggttggggaagcctcaggaaacttacaatcatggtggaatgggaagcaaacaccttcttctacacatggcagcaggaaagagaaatgccaagcaaagggggaaaagccccttctaaaacttgatcttgtgagaactcactcactatcaaaagaacagcatggggtaaccacctccatggttcaattacctcccaccagctccccgccttgactcgtggggattatgggaactacaattcaagatgaaatttgggtgggaacacagccaaacaatataattccaccccttacccctccaaaatctcatgccctcacatttcaaaatacaatcatgcctttccaacagtctcccaaagtcttaactcattccagcatgacacttggggattatgatcattcatagatgaccaattcaagatgagatttgggtggggacacagccaaaccatatcaatcacatagaaatagttttaataatttatgcttagcacttactctatgtcaggcactgttatcagagctgtacctatgttaacagtttaaagctcacaccaaccctgtgagaaaggtactattagcatttgtgttttacagatgggaaaacctgagctatagaaagattaactaacttgccccaaatcagacaattattgataggtggatctgggatttgaacgaaagtggtttgggtctgaagaccattgttggaaccattacactatactacctctccaaatgatacaaaacactgaagtgtttcatacaaaggcaagctaaaaagtatgggaatgtgcaagaaacaaaagaagctcagtccagactgatgaataaaacctgtagctcatttttgttggtgcatgtttgggacctcagggttgctcaggcatcaaacattacaggcttttgccagccagccttgtagttactttggtgatactgtttcctcaaaaacactgtaggcatttgatcaatttatttctcactatattaactcataaagagattgtctttacctagatctttaagagcagctttattgagatataattcacataagataaattcacttaaattgaatattatcaaaatgaaaatcttttttgatacaattcatacaaccaagaaagtaaaaataaaatctatggaatgggtgaaaatttttgcaaatcatatatctgataaggcagtggtccccaacctttttggcaccagggactggtttcatgcaagacaatttttccacaaatggttgggggtggtggtggggtggggaccagatggttccgggatgaaactgtttcacctcagatcatcaggcattagggtctcataaggagtgcacaacctagatccctcacatatgcagttcacaatagtgttcatgctcctgtgagaatctaatgccaccgctgatctcacaggatgcagagctcaggtggtaatgcttgctcacccactgctcacctcctgctgtgtggtcaagttcctaacaggccatggaccggtaccagtctgcacccggggtttggggacacatgtgataagaaacctgtatccagaatatataagaaactctttcaactcaataataaaaagacaagtaaccgaatttaaaatgggcaaagaatttgaatagacatttctccagagaagatgtttatttttcacttctcactcattctttctggtgtcttatctaagaaggtgggtctatgatccacttagagttgatttttgcgcatagagtaagcatggagtacaacttcattcttgtgcatgtggatatacaattgtcccaacatcattttaccaaaaatactattcctttcccctgaaattgctctagcacctttgttaaaaatcaactgaccataaacatgtggattgatttctggaccctcaattctgttcctttaatctattggtctatctttaagtcagtcccatattgtctccgttacagtagctttgtagtagttttgaaatcaagaagtatgaatcctccaacctgaattttttttttttggtcaagactgctttgactattctgcatctcttgcatttccacatgaattttaggataaatttatcacttttggcaaaaaaaaaaacagctggaattttgatatgatttgtataaaatgtatagataaatttggggagaagtccatctaaacaatattatgccccgtaattcatgaacattgaatgtttttaaattttatttaggtcttctttaatttatttcaacaatattctgtaggtttcagaatacaattcctatacttattttgttaaatttatttctaagtgtttttttcttgatgctattgtaaatgaaattgtttacttaattttcagattgtttcctgataggatataaaaatatatgacctatgtacccacagaaatttttaaaaaataaaatttgtaaaaaagcttaataagaacaacaaaataaaaataaaaatacggttaatgtttgcaaattaaacttgtattctgcaactatactgaactcattattagccataaaattttttgtggatgccttaggattttctgtatacaagatcatgtcatctgcaaagaaagacaattttaccttttcctttccaatatggatgtttgatttatttttcttgcctaattgtcctggctagaactccagtataatgttcaatagaggtagtgagaacagatattcttgccttgttcctgatcttagggggaaagcattcagtctttcacctttaagtatgatattagctgtgggttttttcctagctattctctatcaggttgagaaaattgccttttattcctagtttgttgagtgtttttatcatgaaaaaaattggattttgagatgattatacacttttgccattattaatatggtgtattaaatgaattgatttttggatattaaattgaccttgcattcctgggataaatcatacttggtcatggtgtataaatctttttatatgttgctggatttggtttgctagtattttctttaggatttttctatctttataaaatatcctgtctgtagcattctttataagtgatgtctttgtctggttttggtatcaggataatactgttctcatataatgaactgagaagtattccctccacctctatttttttagaagtgtttttgaagatatagggttcattcttctttaaacacttggtataattaaccagtgaagctgggtcctgggcttttgtgggaaggtctttttgttttattactaattaaatttctttacttgttatagttatattcagattttctatttatccttgagccaatcttggtagattgtatcttttttaggaatatatccgtttcatatagtttatctaatttgttgacacagagtttttcatagtttctctataatcccttctctcccccataaatgttggtagtgatgtcttctctttcattcctgattttagtaatttatgtcttctctctctccctctctaagtctagccaaaggtttgtcaatattttaaaatcttctcaaagaaccaacatttgatatttacatacatgtttaagcctaacttctctaatctttcacttcctagaattttaacgcttctcatccccctctctctaaacataaagacagattaggttaatttaggagtagaatgaacaactaacataatactgaaaatctaagctttttgcttacttaatgtaggcagtttcaggctagtgtgatactccattactataactccattttctattatctgattgcttagccattctcaaaagttgaccaatttggctacttgagccctatcactatgtcagcattccagccagcacatcaatattctggtcagcaggaaatagactagcattttcactccttttaagaagacttccccaattttgatgtaccactttcacttacaagcctttggcctaatcctactatttggacacactgaacaactaagaggcttggaattgccatttatttatggtgttttacttgcccaaataaaattctgacctccaattattgaggaaacaaggaaacaatacttattgaaggataaaaccctgtaagaaaagtatgttgtaatatttagtgtatgtatatattttgaatttatatgacaatttactctatgccttgttcaatattctgctttttatatttaatagcatttatgaaaataattataaataaaccaatattctccatatatggatatatgtgtcatatgtataatgtatgtgtgttttagatataatgattatgagagtgaacatttgtgatttattctcccttctgctcttatctgcaagaatcagaatactctcattcctgattctctctttagagatgaaaaggatttttcatatgctctataatcatttaaagtactgattctcaggtgtttgtatgaataacagtcacccaggaaatttattttttaaatgtagattccaggttctatcccaagagagccttattcagtaggtctagtgtagagccagaagcttgaattttaaataaggaccccaggttgttctggccacagtttttgagaaatttactgaattaaggaatgtgttggccagctttttcattaacataaaatggatttagcaaggaagacacatgctttcttcctctctatggactcttgaatatggtttttttcattgcttgtaatgaagcctgtctgcctagttgctttaaagcgaaactttaaagatatcattatgttagttaaatgatttatgaaagcagtgaaagcaaagatggagaagggtaggtctccttattcaacttataggcagataatctatattgttcttggttgagtatagccgttataatggaatgatcaaagcattgtctttttttggaaagatcaaaccattttcttttctgtgacaaaacttatatctctcaattcagtctttgagatgtatctcatccaactctcctacatgaacagaattttccaattagattcaacaccaggtctcagcatggggttttattatagatgcatagacactattttcacaggtaattctgggaacttcttgaaactctcccttatatcaatgagctgtgatgagaatgaagtttgagcagaaatgtaaattttgtgatttgattaaaattaaatgacaaagtttattaattctatttactatgtgagcagtagatttaaatgaatttaaaagtagatgttttttaacattattttagtttcaggagtatatgtgcaggtttgataaataggtaaattgtgtgtcatctggagttggcgtacagattatttcctcactcaggtaataagcatattactcaatagggagtttttttttaatcctctctctcctcccaccttccactcttaagtgcacatgtgtccatgtgtactcaatgtttaactcctacttataaacaagaacatgcagtatctggttttctgttcctgcattagttcccttaagataatggcctccatttctatccatgttgctgtaaaggacatgatcttgttctcttttatgactgtgtagtattccatggtttatatataccaaatttttttatcaagtttatcattgatgggcatttaggttgattccatgtctttgttactgtgaatagtgctgcagtgaatatacaagcgcatgtgtctttttggtataacgatttattttccttcagatatatacctggtaatgggattgctgggttgaagggtagttttgttttaagttctttgagaaatcactagactgctttccacaatggctgaactaatttatattcccaccagcagtgtataagtgttccctttcctctacaatcttgccagcatctgttatttttttttaactttttggtaatagccatctgactggtatgagatggtatctcattgtggttttgatttacatttctctaatcattagtgatgatgagcattttttcatatgcttgttggccacatgcatgtcttcttttaaaaagtgtctgtttatgtactttgcccattttgtaatggggttattttttgtttgttaatttaagttccttacagattctggatattaaaccgttgctggatgcatagtttgaaaatcttttctcccattctgcaggttgtctgtttactctattgatagtttcttttgctgtgcggatctttagcttaattacatcccatttgtcaatttttaattttgttgctattgcttttggcatcttcataataaaatctttgccaggtcctgtgtgcagaatggtttcctaggttatcttccagagtttttatagtttcatgttttaaatttaagtctttaatccatcttgagttgatttttgtatatagtgaaaggaaggtgtccagtttcaatcttctgcatatgactagccagttatgccagcaccatttattgtacagggagtcctttctccattgcctgttatttttgactgtcaaagatcaatggttgcaggtgtgtggctatatttctgggcttcctattctgtttcattggtctaggtgtttatttttgtaccagtaccatgctgtttcggttactgtagccctctagtatggtttgaagtctggtaatgggatgcctccagttttgttctttttgcttaggattgccttgactattcagtctctaaaagtagatttaaaataagcattaattatttccttagagtaagtttctataggtagaattgttgaatcgaagtgtaagaagggtttgatgtagaaaccccaactttagaaatttatttttaagtagtcataatagatataaaccaagatccatacacaatgatgtttatatcagcttaatttataatcagaaaatattagaaagaatgccttatagaaggatacttattatgtgaatcatggcatattcatatgattgaaaaatataccacattaaaaatcataggtcataataaacatatgtgtgcatgtgtctttatagtacaatgatttataatcctttggcacaatagcaaagacttggaaccaacccaaatgcccatcacttatagactggataaagaaaatgtggcacatatacaccatagaatactatgcagccataaaaaaggatgagttcatgtcctttgcagggacatggatgaagctggaaaccatcattctcagcaaagaaacacaagaacagaaaaccaaacacctcatgttctcattcataagtgggagttgaacaatgagaacacatggacacagggagaggaacatcacacactggggcctgttggggggtagggggctaggggagggatagcattaggagaaatacctaatgtagatgacaggttgatgtgtgcagcaaaccaccatggcatgtgtatacctatgtaacaaacttgcacgttctgcacatgcaccccagaacttaaattaaaaaaaaaatgttagaactctgttaacataacaaatgctcataacatattgttaatattttaaaaatcaggttaaaatacaatgtatagtacataatctaaatttggcaaaaaatataaatgtatttatatttggcaaaaatatataaatgtatttacatacacacccacatacacacacacacacacatatatacttagaaaaaagagaataacacacacacatatatacttagaaaaaagagaataacaatgtgttaacaaaatgttaacagggttgtctctggatggttgtattacatgtgatatttattttattttgtgctgtgtctgtgctttcctatattatactttctattgtttatgcttttttacattatgttttctctgttttacttacataataataaaaaagtgttattttatgaaataaaattataagaaattaaaatgtaccatttgtcaactgagatgtaatataactcaggtttaaatggatgtacagacttgttgtcccactaaatctattagcacaaagtttataagctgaatttttaaaatgtgacctttacccttttttaaacaaactgcattattaaaaatctttttggagaaactcatttggtgacattgagggaactgatgatatgaatcatttggttttattattgcccacaccatgaaccccttcgctcatgaaacaggtgaatattcttgagtaacaacaatttgcattccttagatagaagatctgtatacaaatggtagaacgtcagacctttagagtgtatcttaacacagatttcaacaactttcttgttaatagaacaaacagcagtgccactaaatccccacacatcccgtggaatattttgtcattaattaactatctctttttctgaacataagccatttagctttttagtcaatgagttcaaattttaaaaagaaaagaacaaactcaggattgtataaagatcagttttaagatcctgagacttcaagtgagcaaaagtcaacaaatcctttagaaatatatagtgtagcagtatttcctccaaaattgttctgcgtgcagggcaaggaatgttgggggtgaaattgggttctgaatatttaagatacagttgagaaactaggatgaccacacaggtagcctaacacaacaacagatcaggataaccaatgtaaaatcatatagggcgaatagttcttaagaggaaagtaacatttattgagcatcaattctgtaccagactctgttaatgggccagtaagtaaagaggagcatcaagtactgctacaaaatttggattcaattaagaatgaacaagagataaataatttcttatgatgtttgtcatcattctgtttcagagaaattagagctattattttagtataaattgacacttatcctgaatacgcaagcaagcctctttctaggcaattactcactttcttttttgaatttagtttttattctatcaaagttatacaagtacataacctaaatagttaactaatgtagttctacaaaacttgttaagataacttctctgactccctctcttccatattgtttgccactttgagacaaccaatcttatttttgcaacatcattgtagtacttaccatcacattgataaataatgtatttatattgctacttaattttggttcttttttggcattattttcttcttaccatagaaaatgagaagttagttctctttcacaatctccactatacttcatatgccccatcttatagaggaagttaaatttttcagtttttacatgattatgaaaaagcaaatacctaactgagttgagctatgtcgtaagctatgtttgcttgacctttcctacccacatttaattctcctcacagttactaatgaatctggttttgattgcttagttttctgtgtatttatcaataatttggccccaagctcttcccagatgtgtaaatcttctttcatacattgaagcgcagtttccttttcttaatgtccttcccagaacaaatttgtgtgtgtgtgtgtctgttttcttcccccttcttagtattttcccttattttagaggtgcatattctgtagcagcttcctaggaaatggtacatggtggcacagtttttgagactctgcatatctgaaatatttttattctacccttggcttgactgattcatagtttataagtatagaactctaggatgaaaataattgtctgtcaggattttgaaatcatagtttcattgtcttctagtttccaatattgctgagaaatctgataccattctgagatctgagcctttgtgtgaaacacgttctttctccctaaaccttttaggagctttttctctgcttcaatgttctaaaattttatgataacgttttggtgagggcaatttttatccactgtgctaggcacttatgggccttttcaatctggaaactcatgttcttcaggcctgggaaattgcattagattatctctttattttcttccctctgatttctacattctctccttctgcaactcctatttttgaatttaaatctcatggatcaatctatttttactatctttttctcctttttctacttctttgactttttgctctactttcttggatatttctagatttatcttatgagcttttcttatctgataaattattttaattttaggggctcttatccctttgaagatactagtactttttaaatcatgttttcattcataatctctgcttcctccaaattgtttgggtatgtctatttgttttgatatttctcttttatattggagacttttttcaaattgcctagtcattctcagctgccactttataattaatgttctaaaaagcagattggaagctccgtgtagaggatgagttttgttcactgtggcttcatagtagtgtaatctggtaaatcatttcttggaggacacttgaattttctgatctccttaccataggggtttaggcttggctgccagaattttggaatcttagtggggaaataattatggggttcttaatagtcaacatgtgaactttcacatgatccctttttaaatataatagcccaaactttagttaaacctagtatctctcattccagagactgtttatgttaccttctctagataattaattttcattatttttccctaggtagagaaaaggcagcatgtccattacatgaagtagggaaggggcttgagttctaacttctcacgtaaattcaagcaaacttttaaagctagttgttcctgcttttagcccttcattcatcttccaggtgttcctggtactatcccttcctgagaattttggaggtacagtggtaaaaatccggctgtttcttggcttcctctactgtaagcttgggattcagcctttctgggtgtgccaagtcagtttccactcatccatctgctttccatattgcaatattttgtttcctgttatcttcttttctattcttttggtcctattaatagtatgcctctttcttgctttaatctttttgctatcattttagtggagtcttacgagggtaacaaggcattcaagcaccatttttaactacaagttggtagctcttttttgtaacttcaaaacaggatggagatatatgatcatgaagtaagaagcatgaatttctgctgcattattctctgcggaagcatggagtagcttcttttcatcagtttaaattaggcctcagcataaatatcacttcctcagtgaagtcttctggatctgttcatttcaggtaactcctcagtcctccattattttctagggcagtgcctcaccttctcccgacccacagaaataacaatttaggtttatttttccatataatattaaggggatttggtcttttttccaagctagactgttagttccttgagggaaggaagaacaatatgtctctggcttaccagcacttaaaatagcaccaggcacagagtaggcactaaataaatatgcattgaattaaataaaatatagagctttctctaaagtgacattgaaatgctgccccaaaccttttcagtgatagatcaaaacagaaaacggcgaaacaaaacaaaacagaaatgaataaggctcagttttatagaagacagctatttatttctcaatcctcaattataatctagttttcccttcttgcactgatcccataagcattagtcctatatgttgttgtgttatcagttaaggaatcagagaaggccagaatcaataaaaattctgtctagcttttgtaacaaaagttcacaaagcctcagatttttctggcctctcaagttctgcattagcaggacttttttttaattgaatatggcctatgaaggggaaaaacatttttggagctagaaaatgtttgaattgctgcagtattagaaaagaaaccaatttatagaatggcacagctgttcactgtatgatcattatgatccttgttatttgggtgctggttgatatttatatctaattagctctctcacacaccatcaagcaatctgcattttgggaatagagaaaaactaaaatatatagagttccaagctgccaaaaacatataacagaatgaatacaggtttaattcactgcagaccgattattaacaaaccactgaaattagttagtttgcatttttacttgtgtgtgtgtgtgttttataggagatgagaaagcaacaggaataaacttcagaaattattttctatcttaaatggttgacacttttttcttattgctcactgaccttggagagctggactgctgtcaaaatgagattttgcaacccattgcctcattgatgtctatttattggtatacatataacattttataatacattaataaaaatgtcagttcttagttctctgttagcaacttatgtgtttcacaactaaagtcatgtttctgctatagtaccatgcataaaaaacacttatggacagtttagtgtttatgaaaacacaagtgataacaactaggttttaacaaactatattatcatatattagtgagaaaagaaaacattatgatgactccactaagttatcacattacatttttgttccatttcccattttaactttttgttttgaaataattttagatttacagagcaattgcaaaggtagtacagagattttatggaccgaatgtttatgttctcccaaaattaatacattaaagccctaaccttcagtgtggctttatttaaagatggagcctctaaagaagtaattaaggttaaataaggtcataagggtggggacctgatctgataggactagtgtccttataagaagagacacacaaaactcacatgatgtctctttctcctcttgcccatgtgcaaaggaaaggtcatgtgaggacatagcaataaggcagccgtctacaatctaggaggagagccctcaccagaaactatccattttgacaccttgatctcagacttctggtctgcaaaactgagaaaataaacttctgttgtttaagccaccaagtctatggcatgttgtggcaacaagagctgacttaagagagttcccatataccttccacccagattcttataataacatcatatataaccatattacacttatcaaaattaataaattaacattggtacatactgctaactagactgtaaaatttactcaaatttactcaatgtttgcactaaagtccttttgccattccaggatccaatcccggatactacattgcatttaggtgttgtgtcttctagatctctgtcaatatgtgacagcttctcagtttttcctcatttcatgaccttgacaattttgtttaatgttttctcatgattggtctgaggttatagaattaatgatatatattaaaagagatgacatcactttctcattgcatcatatcagggggtcaataccttcaataaagcttattactgatgatgttaaccttgattcagtgtggctggatttagtgaccgtcaaagtggtgttgctaggtttctacactgcaaagttactatttttatttttctgcactattttcataaatagtctctaaatccagccatattcaagggtaggggaattaagttctacctgctatggagaagagtatcaaagcatttttgaatgtgcattagaaaacaatcacagtaattcatattttggggaagaaactgagattaaatacatatcctctttctccttaaagttttaccactaattttaccattcatccattgatattgcctgcatgaattaccattgtgatattctttttctatttattttgtgggtacatactatgtgtatatattcgtggggcacatgagatgttttgatacaggcataataatcacatcatggaaaatgggatatccatcacctcaaacatttagcctttgtgttacaaacaaaccaatcacacatttttagttacttttaaatgtacagttaaattattattgactatagttactctgttgagctataaaatactaggccttattcattcatgctaactatcctcacctccatcccactcccacccccgcaacactcccagcctctggtgaccatcctactctccataggttcaattatttggacttttagatccaacaaataagtgagaaaatataatgtttgtctttctgtggctggcttatttgacttaacataatgacttccagttccatccatgttgctgcaaatgactgaatctcattcttttttatggctgaagagtactccatggtatacaagtaccacattttctttatccatttatttgttgatggacacttaggttgcttccaaatctcggttatcgtgaacaaaactgcaacaaacatggaattgcagacatctctttgatatactgattttctttaatttggatatttacccagcagcggaattgttgaattgtgtggtagctctatgtttagttttctgaggaacctccaaagtgttctccatagtggttgtattaatttacattcccaccaacagtatatgagagttcccttttctccacatccttgccaccctttgttaatgcctgtcttttggatataagccattttaattggggtgagatgatatctcattgtagttttaagttgcatttctctgataatcaataatgttgagcaccttttcatatgcccatttgccacttgtatgtcttcttttgagaaatgtccattaaaatcctttgcccatttttttgattggataattagatttttttcccatagagttgtttgagcttcttatatattctggtgatgaatcccttgtcagatgggtagtttgcaaatattttctcctattttgtgggttgcctcttcactttgttaattattgtttcctttgctgtgcaaaatctttttaaatttatgtgatcccatttgtccatttttgctttggttgcctgtgctggtggggaattacttaagaaatctttgcccagagcaaaaccttggatagttgcccccaatgttttcctgtagtggtttcatagtttgaggtcttatatttaagtctttattccattcagattgatttttgtatatggtgagaggagataggtatctagttttaatcttctgcatatgaatatccagttttcccagcaccatttgttaaagagactgtcttttccccagcatatgttcgtggcacctttgttgaaaatgagttcactataggtgtgtggatttgtttttgggtactctattctgttccatcggcctatgtgtctgttcttatgccagtaccatgctgttttgtttactatagccctgtagtataattggaagtcaggcaatgtgattcttttagttttattctttttgcttaggatagctttggctattctgggtcttttgtggttccatagatattttaggatagtttttttctgtttctgtgaagaatgtcattggtattttgataaggattgcattgaatctgtagattgctttgggtagtatgcacattttaacaatattgatttttcaatccatgaacatggaatatctttccattttttggtgtcttcttcaaatcttttcaccagcgttttatagttttcattaaagagagctttcacttctttggttaagttaattcccatatattttattttatgtatggtgattgtaactaaatttatcagttgtaatagttttttttgtggagcttttagattgttccaaacataagatcatatcttctgcaaacaagaataatttgatttcttcctttccaatttggatgccttttatatctttctcttctagctaggacttctggtactatcttgaataacagtggtgaaagtgggtatccctgtcatgttccagatcttagaggaaaggctttcagtttttccttattcaatatgatactagatgtaggtctgtcatttatgtcttttgttatgttgacatatgtttcttctataccgagttttttgagggtttttttcatgaagagatgttgaattttatcaaatgttttttcagcataaattaaaacaatcacatggtttttgtccttcattgtgttgatgtgatgtgccacattgatttgcataagttgaaccatccttgcatccctgggataaaatctcacttggtcgtgatgaatggtatttttaatatattattaaattttgtttgcttgtaatttgttgaggatatttgcataaatattaaattggtgatattggcctgtatattcctttttttgatgtgtctttggttttggtatcagggtaattttagctttgtagaatgagtttggaagcattcaatcctcctctactttttgatatagtttgagtaggatttgtgttagttctttaaatgtttgatagaatttagcagtgtagccattgagtcacaggcttttcttcagtgggagactgtttattatattttttaacttttattataatactttacttgttacttgttattggtctgttcaggttttggatttcttcatggttcaatcttggtatgttttctgtgtctaggaattcatccatttcttctagatttttcaacttattggcatatagttgcttaaagtagccactaatgttcccttgaatttctgcagtatcagttttaatgtctctttttccatctctgattatatttggatcctctctctttttttatcacatggtcaagctaaaagtttgttgattttgtttaacttttaataaacaagtttttgtttcattcatcttttatactttttttcatttcaaattcattaatttctgttctgatcattattatttcttctcttctaccaattttgggtttggtttgctcttgcttttctagttctataagttgcatagttaggttgtttacttgaaattttcattcttttttgatgtaggtgtttatagctataaaattccctcttagcactgctttcctgcatctcgtaggctttgatatgttgtgtttctattatcatttgtttcaagaaaattttcaatttctttcttagttacttcattgatccactggccattcagcagcatattgtttaaattccatgtatttttatagttttcaaaattcctcttgttgttgacttccaattttattccattgtggttacagaagatgcttgacattatttcaattaaaaaatgttttaagacttgttttgtgacctaacatatgatccttgagaataatccatgtgctaaggaaaagaatgtgtattctgcagttctcagatgaattgttccgtaaatatctataagatctactttgtctatagtagagattaagtcaaatgtatatttgttgattttctgtctggaagatctgtccaatgctaaaagtggggtgttgaagtctccagctattattgtattggggcctatctctctctctaataatatttgctttatatatctgggtattccagtgttgagtgcatatatatttacaattgttataatctcttgctgaattgacccctttattattatatactaaccttgtctctttttatagtttttgtcttgaaatgtattttgtctgacatatgtaaaactactcctgctctttttgggtttccattggcatggaatatattttccatccttttattttcagtttatgtgtctttatatgtgaagtgtgtttcttgcaggtaacagattaatgggttttgctttttcatccattcagccactctgtgtattttgattggagagtttagtccatttatattcaatgttattattaataagtagagagttattcctgccattttgttgttttttggttgttttgtggtcttctcttccttaattctttcattcctgtcttcattttagtgaaggtgatttttcctcttgtgatatgatttagcttcttgctttctactttttgtgtatcatttatatggtttctggtttaaggttaccacgaggcttgcaaatactataacacattagtttgactgaaaacaacaatatttgcataaacaaacaaataagcaagaaaaaaactaataaagactctaagtcttaactttgtccccattttttaaatgtttgttgttgctatttatacctttttgcactgtgtcttcaaaagttattatagttatttttgactcttatttagtctttctacttacgataagagtaatttacatgccacagttacagttttatgattacagtgtgtttctctgtgtgcttactattaccagtgagttttgtaactttagataatttcttattgctcattaacatttttttctttctgattggagtgattgttttagcatttcttgaggacaggtatgttgttaatgaaatctctcagcttttgtttgtctgggaaagtctttattttttcaagtttgaaggatattttcactggatatactagtctagggtaaaagttttttccttcaacactaattatgtcatgccactctctcctggcctgtaaggtttccattgaaaagtctgcgctgctagacgtgttggaactctattgtatatttgtttcttttttcttgctgcttttagaatcctttgtttatctttgacctatgggagtttgactactaaatgccttgaggtagtctcctttgggttaaatctggttggtattctatcaacttcttgtacttggatattgatatcgttctctaggtttgggaagttctctgttattatccctttgaataagctttctacccctatctctttctctacctcctctttaaggctaataactcttagatttgccctttagaggctattttctagatcttgtaggcatgcttcattattttttattcttttttcttttgtctcctctgactgtgtattttcaattagcctgtcttcaggctcactaattctttttcctgcttgatcaattctgctattaaaagattctgatgcattcttcactatgccaattttatttttcaacttcagaacttctgcttgattcttttttattatttcaatctgtttgttaaacttatctggtagaattctgaaatgtcaattcaaatattttgcccatttaaaaatcagtttattagatttttttctatagggttatttgagctccttatattttctggttattaatcctttgtcagatgggtagtttgcaaacattttctcctattcggtggactgtctcttcactatgttgattgtttcctttgctgtggagaagctttttaactctatgtgatcccatttgcccctttttgctttggttgcatgtgcttgtgggatattgctcaagaaatttttcctccttgggaaggctttccagatatttgaaaagacttgcatgttgcaatttatgctgtatcttctttgagggggggaccccaacctcattaatgctgtggttcttgcagacttgtcaaggtactgccttgatggtcttgtccaagatctggaagaattctttagattactaggcaaagactcttgttttctacccttactttcttccaaacaaatggagtctctctgatctgagctacctggagctgggcatgcagtgacacaagcatccctgtggccaccacccctaggattatgctgagttagacctgaacccagcacagcactgggtctctccccaagtctgctgtaaccactccttggctgcaaccacctatgattgctcaaagccctgggagtctacaatcaccaggtggcaacaccagccaggcctgtcactctcttcagtgcagcaacttcccccatgccccaggtgggtccagaggtgccttctgtgagccagggactagagtaaaaaatcttagaactctacctggtgttctactgtactgcagctgagctggcactcaaaccacaaaacgtagtccttcccactcttccctccctttggctaccacaggctcatggggagtactgccagactgccactggtattcccttaaggccccatggatcttcagtcagcttgtggtaaatgctgcctggcaagggactcatccttctggggaactggctcacctctggccctgggcaggtccagaaatgccatcccggaactacgtcctggattcggaaaccccaagtgcccatttggtgttctaggtcctgtggctaagctggtatctgaagtcagcaagtgtcagagtctcacccaaagcccttcatgaagcatctgggtattgctgctggttattcagggctcaagggctcttcagtttgcaggtggtgagaactgccaggactgggtccttcttttcaaggagtgggttcccttctggcacagggtttgtccagaaatgtccaggaactaagacctggaatgaaggcctcttgactctggccactaccctatgctgctgtggctgagctggtaccaagatgcaagacaaagtcctccccaccattccatcttctcccctcaagtggaaggaagaggtctcttttggtgctgtgagcagtgtagcctaggtttagggtaggggtgatgccagcacgccgtttgccaccatggctggtgtctcagtaggtcatgtgctccccagtccactgtctctgagcccagttgagccctagaactcacataggtgttatagtacttgtggtctagattgcctttcaagtttatttggggttgagagcatgttagcccatggtggtaaggcttgtgggaactaaaattccaaccactgggatcagtgatttccctcttgctcggactggtttaaatgctccttctgtgggcaggcatcagctgaggttggtctggttttgctttctgctgtgatagaactgcactgagttcaatgcctcacaagtactggctctccttctcgccaggacacagaaatgctctgccccccacactgctgctgccagggggcccaggagggatggcatcagtgattcaggactgtttagtctacctcttcagtgcctctttcagtgatatgaagttaaaaccaggtactgtgaatgcttacctgacttttggttcttacaaaggtgtttgtttgtatgtgtgtgtagttgttaaattgatgtccttgcgagaagaaagatctgtatagccttctattccaccatcttgctctatccctcttcctatcactgtgatactaatggtgattttctagtttctttatttattttacatttattaattggaatttttctgcaaggaagatttatcccttcatccctattatttacttatgttagtatggactctcagatgtttattttattctttgggctataatccaatattattatttatttcgttactcaaattgttccatctttggcaattgggatgtcttttagactgactccaatgtccttttctttcttttgtttttcttcttgagttcttccttactttcatgaaccacaagatactacaggtacagtttctattttctctgacctagccctagaatcagccatttctccaaatatccttggttgcttatattgtgtgtatgtatgtgtgtgtgtatgtatgtgtgtgtgtgtgtgtgtgtgtgtgtgtatatatatatacacacacacacaaacgtgacttcatactgatatctccaagtctaatctagtaccacagggttcattctagcattcctccttgtttatttcctcagacagtgtgaaacctgattcaattatctacaatatatttactcatttgttcaaacctattatacgagtaatttcagaattgctaattccttttactgtgagaaaccaatttatcagcaaaagcccattttgtagttttttgttttcattttttttgtatttagcctaacactgtctgttcaaaacactgttttacaaagttgcttaggtcaactcctttcttctccaagcacctttagaaagtatcccaaaccctattctaagagattttttttcagtagtttttgggcgtggctctggaatttttagttttaatcagcatcccagtgattaatatacagataaaccttggacctcagtttgtgatttactgatctaggatatgttgggtataaattgagcacatctccacccttcattcctggagagcccacaccagttaaaaaacacaaagctaaaaatatctcattaagccaagccagagaggagcattataagtactccatggagattaaacccttctcatatttaccttctctctacttctgcactgagttctacttacttatgtgtaagtctaaggaaaagggatatcaaataaattgtggcttcttgtttctccttaagtattactctagcaacagaaactggaagacaatttcaggaaataggaagatcagagactatggaactcttatagcaggaacaagctggagtcaacctccctcgtaaccttgagttaattctttattatgatgagtgctctggcacattcctgctttggcacttcattgttccagcaaaatacgacatgagagctgctgcctttggcaagcaatacttaacaataaaactcttcacctctcatttgcaaactccagaaaacagtactaatgataatttctgttgcagacttaaaattagggccatttgattatttacattttacagatgacaaaggagaaaacacaactggaatgagaattcagtactcaaattactaacgcttaactcttatcaattgcataacatgaaaaccttctgtttgtgtggcctctctcttttattggtcattttcaagggacatttacttgcatagactttaaggaacaatagaaatctctattatggtaacatagagaaagttaaaatatgacccaaatatggtaaaaggtttgatttctatagttttctttttacttttcaagcttcaactctaaggtaatgctctttccttgaggtatgaaaactgggtaacattttgtgagataattccagccagcagttagttgtatagaacttctagcatttctataataagaataccactttatgacttagtaatacagtgatgttgttaaatagaatgaagaatttgcacagaaaagatacaacccactttgaagagctttgtggttcaactggtaatcatcactggggcagttctctctgattcagtatctggtactcagaattcgtaattcagaataactaaaaggaaatccattcagaggttagcttattggatttggatccaccttttaaaaaagaaaaagaaaacatcagaagtctatgtgccttagaaatcatgtagtacattccttatcagtcttttgcctgacataatgtcctttattgccttttctaatatagagaatagtttgctgtaatgcagcagtcactcccaacaaacattattattgtgtgacttgccctgacttttctccctcctttcttcatttcttcctcctctctcttactaacacccccgccccccgccaccaccccttatgcacccagtcactcatggataataaactatcattctgctatgaaaccaagtgggccactcctcacaactccacagcaatctgtgaaaatagagtagagatgagaattcagaatgcattcgatgttacagctggtacagctgtgctctgaatctggtcaatgtatatatttatttcagaaggttgtgaaccagtagaaaataggaattttgcaaatgtcaaattattatgcccctttattcctctgaattttagtacctgacaattggccaattagcaaagaaccggtatgtgttttacatgattcatttggcataactcaacacccttctatctgaggagactgcaaatacagtacatgactgtattacgtaattatatgctatattatctacagctaatagaaagagacattgttgcatagagataggtcaggtttacatgtttaaatgctgttagaatgataactctttgttcaattgcatataaatggaataaaaggacatgatttgtttagcctggacagtgttctcagcacagtacagagattaaacatttaactcatattgagagagacactttctcctcaagggatccataaacaacacctatcacactcaaagaaagacttctcatttgatctcctagaaatattcccagggtatctttcacccctgccagctgttgtcacagtttgacagtgaatgtatcagcaagacaacaatgcctaattgcctgcaccctgtcaattcaatatagagtagctttggtcatccataccctgcttatgataacagtcaaaggaaaagtggatgtagaagaaacactaaaagactgaaatgcctttctgataagttgtcaaatagtgaaagagctctttgcttgatacccaactatttttaaaattgccacccaacttaattcttaatattaagtcttacgtgattatactgtaaaactccgaggaattaggatctcgaaggcagaatgatgttgacatatatacctaaaaccattgcccctgggaattttcattccatggcaaatttatatacatgcctatattttctatagcagagaaatattggaagaagaggcgtaatcctgggaaaaggtattgtcatagccagcaataagaccacagcaatgttagaagacagtgttcacacccgccttaagtcttctgataacttccaacgcaaaaagaatgaaggtagggaaggagactgcatctatgaaagggaatgagggaggaggcggcccaaatagctgcctatgaaaggaaagtgctaaagacagatctcactagaatgtatcaaaaagatctttactgtatgtcaatgaaaccttcacagaataccttacagaatgagaaagaaagaacgtacaaatatttgatgtccctaccatatgccaggcctcatgcttgctactttatatatgtgtgatctctccctaatcttcataacagcactatgaaaacaagaaagtactggtttagagtggttctgtgtttcatccaattctgccacttactatgtacgtaccactgaacttaggactccaatagaatcaactcaggcatacttccctagccacaattaggaaaattaatgaacactgaaaactggagatggttagaggaacctccttagctactcagagttgttccccatgatcttttcagtctgttttcagaaacttgcttcattatcagaaaactgctctgtatgcacagcttctctgaatgtgtccttcatttacttatctaacctgaaatttggtagttcctaaaaaattctttctttttcttgctagcatctcaagtggacattgttttgttttcctttcataatccaggtaactcagaagttgaaattggtatcttccttgttcctcaatattacttatagacatttgcttctcctccctcttgctaaaacccctgtttctattaggatcacatagtcattatagcttgcctctttttcaatagcattaacctggaaaaatttgaatctaaatgatcagtctcttgcccagcagataagaatcaaacaaccatgtagattagtatctaacaccctacatgtgtgatcatgcaaacaaaattagtactcagaaaatcccagcaatattaacaaatgtctctttaactttgctttcaaactctctgcaattccgttttcttaccttgtttattcttcctaaatatttaaacaaaccatcactgccctatgtctcggattttatagagaaagtagaacttattagacagaaattgcttcatcatcattaaatcagaaaaaacaaaaacaaaaacagaacataggagtgcctgctcccatatttggtttttccctcctattataatagaggaagaagaagcgattccagtaagtacatgaccctcaaaccacagtttccaaaagactatgagacagatttaattcacagatcagttaaaagtcacaaggatggcaatgaaaacaagaaatatggagagtgactcattagtccagaggtagcagattcacaataataccagcacaaacaacttcctgaagggaagttgtccttagtttttgctgaaaactaagtgtgagaaatggattagcagggtgagaccccatttctttcaaataataagatatagagctagatgaagaatcacatgcacaagccacatttgcaggaagtcatctgcctctgtggcagtaaagtagaagtaattctttgggtataaagcttagagggctacagttgctccctttccaaccaacctataaatagctggtctagaaaaatccaattaattcagtaatgaataatatagggaaaaactggcatgatattgacacaaaaaatgtcataagaaaaatacagaaaagggctgcaaaatttagaaacaaaagaacattcaccagaatgtgtttcaatacacgatttaaagacaatggatcaatcacatttaaaaacaaaaatcacagatcagaaatgtacagtcaggaaagaaatgatgtgacaacagaagcaatgaagtatgagctggaatcactaaggaaataagagcattaattttaacaaaaacctgaaacaaaaacaaaagtggtgggatgacagaagaaaacagtatggaaaattgggtgtgatactgtgaaataatgtataatcatatatatatagaagattatatatataagtaaagactgtatgtgtgtgtgtgtgtgtatatatatagagagagagaaagagagagaggagagagagagagcggtcctaagacctttataatttactgagtgataggaggatagggcaaaggcctccaaaatcaggtgacagactcatcgtttgttctaatgaggtaacttttggtgggctcctggatagcatcaggatgggggctagttgccaggaaaatgacccatgtcattagatgggtggaactgtcagtccaatcctgacctccaggaaggagagaggggctaaaattgattttatgaccaatggccaatgatgtaatcaactatacctgtgtaatgtagccttcataaaaccccaaaaggacagggtgagaagagcttctggattgctgaaaacatggaagttcctggagggtattatgtttgggaaaggcacaaaagctccatgccccttcccacataccttactctgtgcatctttttcatttcgctattcatctgtatgcttagaaatatctttcataataaatgaatggatgtaagtaaagaaattccttgagttctgtgaggcactctagccaattaattaatgaggagagtgttatgtgaacccccaatttatagctgattaatgagaagtgtaggttacaacctcctgcttgtcattggaatctgaagtcaggggcagtcttgtgggactgagccctcaacctgtgggatgtgatgctatcccagatagatagtataggaattgacttaaaattatagacacccagttgttgtccattgtgagaaatctctgcacattttgggcacagaagtatactgtgttgagtagcataagagtagagagaaaaaaaaatttttttaagatgtggttagaaacttggaagatagaaattgggaagtaaatgatgatgataataataaagtgaataaagagtttaaaaggaatgggtgaggcaatgatagacttagaagcctggcaaaggagagtgaacttatgtgtaactggagtacctaacgaagaaaattaaaacaatgaaatagaacaaatatttcaatacattattcaataaaactctactaaaaaagagaaggcaaagctatatatatatatagaaagaactgtgtaagggacactgtgtgtaagagaaaatggaaccagaatggtcaatgctgggaaatgtcctagtaaagttgtgggttgttaaagatagttaaataattctttgaacagtcagacaaaaagatcaagtcacgtatagagagaaaagaattaaactagcctcaattttttccatagaacaattctatactaaaagatagtgaaacatctacaaagagttcagggatagaaaatgcgagccaatgatttacatccagtcaaactgtccttcatgtgtaaagactgtagacacatgcatttgaattggccagatttcagaggctattgttctgtgagcttttatgaggatactgcaagagaaccattttgagccaaaacaagtgatgacaaagaaaattaagctaaaagattggcaatgaattttgaatacttttaactgtataaataaagccaaaacaaatgtgggaatagagtgaaagagcagaaggtaaatgttatatgccttaagaatgtcaaagtcatgtaattaataccaattgggagaagtagagaaaagaatgtgtaggtagagtaagtgtactgattagctaattgtaatagaggggaatcatcttatatgccttaaatataataaggcataggaatagttgaggcaagtaatagctatatatttgactatacaaaagaaaattctgagaaagggtatattagtgcattcattattttattataaaaaaagaacacatatacctttaccatctgcaaagataaatagacttgcattaccaatctaaggaaaagaggaatttaagattgtatcacaaagcaaaactaaacactacattgtatatataagagatacacataaaacacagttactcaaaagggtggcaagtaaaaatatatcccaggtaaatgcaaacaaaaaatggcaaaggtcaggtttttaatataaacaaggtagaattaaggccaaaagcactgaaacggatggagaaggacactccaaagtgataaaggatgcaatttatatgtaagataaaatagtcatatatttaacattaagtaacatagtaacagcattcacagatcagaaatcataggaaaaaaaggagaaatttataaaagaatacacaggtaggatgatgattcattacaatgaaatgagtctagagatttgtaattctttttttaaattatgaaaacaatgttttctctgtgcaaattaaaaacagattcctataattttagagcatcaaataggaaatacaaaattgaagtatattgtctctaaaataatataataaaagcattatacatcactacctgagagacacagctaaagcaatgctgggggaaaattcaggaccttaaatacgtatatcagtaaaaaagcagaatgtaagcaagtgaattagtaatctgacttaaaattagagatacagcagcaaaatattaaagtttgaattaataaattaacaaagatagagaatatgagatttgggggggttggaaaagtatccaaactatatcgttccaccaaaagccaccaaaatctcatgtttttctcacattgcaaaatacaatcattttcccagtatggacttttgggacactctcacaaacacactcagaaataggttttaacctgggcattccatgtcccagtcaagtagccacatgaagtaaaccatcatggagtacttaaaggaaatgaaaagaaagggcactagacagaatttccaatccacaatattccctaaagtcctaactcagttcaccagtaactttaaagtcctaagtctaaagtctcaactgagacttgcaaatttcttacagctctgagcctgtaaaattaaaaacaagttatttctaagatacaatggtggtataggcattgagaaaacattcccattccaaaagggagaaattagccaaaagaaaggagtaataggccccatgcaagtagtttgaaatacagcagggcagacaataaaccttataattccaaaataatccttgaccccatgtccttcatcctgagcacactggtgcaagaggtgagccctcgagactcagaccgccctgcccccatggctttgctgattcaaatgctaatctcatccagaaacactctcacaaacacactcagaaatatgttttaacctgggcactccatatcccagtcaagtagccacaagaagtaaaacatcatggagtacttaaaggaaataaaagaaaaagaaaggacactagacagaatttccaatccacatgaaataaatagaagccgggagtagtactcatgcctgtaattgcagcacttcgggaggccaaggtgggaggattccttgaagcctggagttcaagactagtctgggtaacaaagtgagattccacctacaaaaaatttaaaaattacccagtgtggtggcatgtacttgtagtctcagctacttgggaggccaagttgggaggattccttgaagcctggagttcaagactagtctgggtaacaaagtgagattccatctacaaaaaatttaaaaattacccagtgtggtggcatgcacttgtagtctcagctacttgggaggctgaggtgggaggattgggtgagccaggagtttgaggctgcagtgaggtaagatcaccttctgtctcttaaaaaagtaagtaaataaacaggtggagaactaaaaagcaattacataagtaaatataaaataaatatatttttgaaatttttttctatatgattaaaatgaaagcagactaaattcatagacacacaatacataaagatgtaattttgatgacaacagcacaaataatatgaaatggagctatgtaggaacaaagttttttttgttgttgtcttttttttttttttgagacaggatctctctctgtcacccggactggagtacagtgacataatcatggcttaatgcaatttaaaactcctgagctcaagaaatcctctggcctcagcctcccaattagctgggactacaggtacgtgccaccacacctagctaatttttaaatttttttgtagaggtgaagtctctctgtgttgctcaggctggtctcgaactcctagcatcaagtgatcctcctgtgtcagcttcccaaagcactgagattatgagcatgaaccactgggcccagctaaggagcaaagttattatttttttgaaattaagttggtaatgatcccaaaaaatcattagaagttgagatgccaattgcaaattccacagaaacctctgagataatctaaaaacatacagcaaaagaagcaacaagataattaaaatagtatagaacactaaatatccatttaatacagaagactagaatagtggaggcatacagaaaaaaagacataagacatacaaaaaacaaatagcagacataaatcctacctgttagtaattacatgaaacaaaatggattacgttctgattaacagacagaaattggcagcacagaatttcaaaaattatcgaattatatgatgtctacaggagggaaacgttagattcaaagatgcaaatagattgaaaaataaaataatgaaaaaaatatgcaaacattacccaaaagagaaccattgtgatattaatattggacaaaatagactttaaaaacaaaaatcttactagagacaaagaagaacatttcttagtgataaaagagtcaatccattaagaagatataacaatcataaacacatatgcacctaaaaacagaaacttaaaaactacaagaattgatgggacaaataatttaacagtaatagagataaatatcacagatacataatcacaaaggaaaaagaacacttgaacagcactacaaaccaactatatttaacaaacatccatatgacactccactcaacaaaagcagaatatgtatttttcccaagtgcacataaaacaatttctgagaaaaaccatatcttaggcataaaataaaagtcactaaatttaaaagcaatgagggactggggcagagcaagatggccaaattaatggttccaccaatggtcccccacttccacagggacaccaaatgtaacaactacctacagaaaaaagcactttcataagtaccaaaaatcaggtgagcacttacagtaccaggttttaactttatatcactgaaagagggactgaagatggtagaaaagatagtcttgaatcaccaacaccacctctctctgccattctctggcagtggccatgtggtgtggagagagaatctgtgcacttgggaaaaggaaggtgcagcaattgtgagactttgcattgaactcagtgctgccctgtcatagcagaaagaaaactggactgaactcagatgatgcctgcccatggagggagcatttagaccaggcctagccagaggggaattgaccattccagtgatcagaacttcactttcggcaagccttgtcgtcacgggctaaagcgctatggggccctaaatgaacttgaaaagcagtctaggccacaaggactgcaatgtctaggcaactcttagtgctgagctaagcctggaaccagttgacttggggggtgtgcaacctactgagacagcagctgggacagataagggagtgcttacactacctgtctgccaaccctagggaccacagctcatggctccaaaagagaccgtttccttttgcttgaggagaggagagaggagaggagaggagaagagagggaagactgaagaggacttggtcttgcgctttggataccagttcagccacagtagaatagggcaatgggcagactcatgaggcccccgttctaggccatagcacccaggtgacatttctaaacatatcctgggtcagaagggaacccagtgccttgaaggaaaggatccagtcctggcagtattcgtcacctgctaactgaaaagcccctgggccctgaataacaagcagctatacctaggtactacactgagggcattgggtgagcctctgagtcttgctggcttcaggtgagacagcacattaccagctgtgctggctatggggcaaactgcttctttttgagaaaggcaaagggaaaagtaaaggggactttgtcttgcaccttaggtaccagcacagccacaggcgatagagcatcaagtgaactcttctggtccccaattccaggacttgacttttgttctgcatttctagacctactctgggtcaaatgggagcccactgccctgaaaagtgagccccaggccaagaagtattcaccacaagctgacttaagagtccttgggccttaagggaacattggctagtagtctggtagtactcctcgtggccttgggtggcagtggctatgggatgaggctcctcagcctttggaagggggaaggaagagtgggaaggactgtgttttgttgtttgaaagccagctcagctgcaatacaatagaataacaggtatacttctaaggtttttgactctagtccctgactcctggatagcacctcggaacccacctggaagaccttgctgccctgaaaggaagaaggaaggacagagacttgggtaactttgccacctgctgattgtagaggcccagggtcttgagcaaacataagcagtggtcagggggtagttacagcaggccttgggagagatccagcactgtgctagctttaatacatgaaaattaaataatgtgctcctgaatgaccagtgggtcaatgaaaaaattgagaagaaaattgaaaaattttttgtaacaagtgataatggaaacacaacataccaaaacctatgggttaaagcaaaagcactacgaagagagaagtttataggtgtaagtgcctacatcaaagagaggaaaaacttcaaataaaaaaaatctaacaatgaatcttaaataattacaaaagcaagagcaaagcaaatgtaaaatagctagaagaaaagaaataatagagatcggagcagaaataaatgaaattgaaattaaaaaatacaaaagatgaatgaaacaaaaagttggctttttgaaagttaaacaaaattgacaaacctttagccatactaactatgaaaaaaagagggatggtctaaataaataaaattagaaatgaaaaacgagacattacaaactgatactgcagaaattcaaagggtcacaagtggagactatgaacaactatatgccgataaattggaaaatctagaagaaatgaacaaatttctagatacatacaacctaccaagattgaaccatgaagaaatgcaaaacattaactaccaataacaagtaacaagattaaagccctaataataataataataataataataataataataaagtctttcagtaaagaaaagcctgggacctgagggcttcacctctgaattctaccaaacttttaaagaactaataccaatccaactcaaactattccgagaaatagaggaggagggaatactttgaaactcattttataaggccagtattaccctgataaaaaacaaaacaaaaaaacaaacaaacaaacaaacaaaaacaaagacacaacaacaaaaaagaaaactacaggccaatatatttgatgggtatggatgcaaaaatcttcaataaaatactagaaaacagaattcaacaatacattagaaagatcattcatcatgaccaaatggaatttgtccccgagatgcaaggatggttcaacatatgcaaaccaatcaatgtgatacattatatcaacagagtaaagaataaaaactgaaaaagcatttgataaaattcaacatcctttcatgataaaaaccctgaaaaactggggacagaaggaatatacctcaatataatgaaagccatacacaacagacccacagctagtatcatactgaatggggaaaaaccgaaagccttttctctaagatatggaacatgacaaggatgtccactgtcaccactgtattcaacatagtcctggaagtcctagctagagcaatcagacaagagaaagatataaaaggcatccaaattggaaaggaagaagttaaattatcgttgcagatgatgtgatcttatatttgaaaaaaacctgaatactccacaaaaaaactattagaactgataaatacattaaagtttcaggatacaaaatcaacactcacaaatcagtagcatttctatataccatctatgaacaatctgaaaaaagaaattaaacgtaatcctatttacaacagccacacataaaattatatacctaggaattataaattatttttgactatagttaccctgctgtgctagcaaattctaggtcctattctttctgtgtaactattttttcacacctgttaaccatctccacatcaaaaaatggaaaaatctttcacgttcacaaattggaagaatcaacattgttaaaatgtccatactacccaaagcaatctacatatccaatgcaatccctatcaaaataccaatgacattcttcacagaaatagaaaacacaatcctaaaaaaagacccaggataggcaaagctatcctaagcaaaaagaacgaaactagaggaatcacattatctgacttcaaattatactacagaaccctatctcttgctatatacaaaaatcaaatcaaaatggtttaaagacttaaactaagacctcaaactgtgaaactactacagtaagacagtggggaaaatttctagaacattggtctgagcaaagattttttgagcaatacccagcagcacagacaaccaatgcaaaaatggacaaatgggattgcatcaagttaaaaagcttctgcacagaaaatgatacaatcgacaaagtgaagagacaacccacagaatggaagaaaatatttacaaactatccctctaactagggattccaatcagaatatataaggagcttaaacaactctatagaaaaaaattctaataagctgatcaaaaaattggcaaaatatttgaatagacttctctccaaagaagacattcagatggcaaacagacatatgaaaaggtgctcatcatgtattgatcatcagagaaatggaaaacaaaactaccatgagatattaactcaccagagttaaaatggcttatatccaaaagacaggcaataacaaatgctgatgaggatgtggagaaaagggaatccttgtacactgttggtgggaatgtaaattagtacaactactacggaaaagagtttggaggctcctcagaaaaccaagcatagagctgccattcaatccaggaattccactgctgggtatataccccaaacaaagaaaatcagtatattggatatctattggatatataaaattcaacatcccttcatgataaaaaccctgaaaaactggggacagaaggaatataagtgcagtatatatctgcactcccatgtttataacaactctattcagaatagccaagatttggaagcaagttaagtgtccctcagttgatgaatggataaagaaaatgtggtacgtatacacaatggagtctccagtcatttgcaacaacatgaatggaactggaggtcactatgttaagtgaaataagccagcaaagaaaaacaaacattgtgtgttctcacttatctgtcagagctgacaattaaaataattgaactcatagacataaagaatagaaagatggttaccagaggctgggaaggatagtgggagggagagtgggaagggaagtgaagatggttaatcggtgtaaaaaatagttacacagaaagaataagacctagtatttgctagcacagcagggtaactatagtcaaaaataatttataatttaattgcacatttaaaataactaaaggagtataattagattgtttgtaacacaaaggataaatgcttgaataccaaatttgccctgatgtgattacacattgcatgcatgtatcaaaatatcttatgtgccccttaagtatacacacctattatgtacccataaaatttaaaaactaaaaaataaaaaattaaagcaatgtaatcttgtaaaatatggaatttaattagaattaaattctaattaaattaaattagaatttaaattagaataaattggaattaaattagaataaataacagagggaaatctggaaaaatttcaaatgtgtagaaattaaacaacataccctaaataataagtgtgttgaagaaaaacatcacatgggaaatgataaatgaaaataagtaaatgaaaatgaaaatataacatcttaaaatttatgtgatgcagtgaaagcagtccttatagggtgatttagagctttatatatctatatcagaaaagaagaaaaatcttgaatcgataatataacctaccaccttaatcacttataaatagaagagcaaaccgaacccaaatcaagccaaataaaggaactaattaggatcacagaaggaataaatgaaatagaaaacagaataacaatagagaaatttaatgaagccaaatgttggtttttgaaaataaccacattgaaaaaactaggtagactggccaaacaaaagtgaatggagactcacattactaaaatcaacagtgaatgatgggacattactattaggttggtgcaaaagtaattgcagtttttaatggcaattacttttgccccaacctaataacaaccttacagaaataaaaaggataatacaaaattatgaaaaattgtgccaaaaattagataacgtagaatgcaatgaacaaattcttagaagtacacaaactaccaaaactgactcagaaagaaatagaaaatctggatagaaatataacaaataaaaagcttgaaaaatagttccataaaagaatcccaggaccacagggcttcactgatctcatgaattgtagccaacgtgataaaatgaattaataccaatctttcataaactcttaaagagaagaagacattttcgagctcattctatgaattcagaattatcctcataccaaaaaccagatgaaaacattatagttaagaaatctatagcctaatgtcccttataaataaagacacaaaaatgcacaacaaataactagcaaactgaatttagtaatgtgttttatataaaacattatctatccatctatctatctatctatctatctatctatctatctatctatctatcatctatccatccatcccatgtgcaagtagttatctcagaaaagcaggttggttcaacatatgaaaattaatataacataccatactaatataatggaaaaaaacacatatgatcacctaaataaacacagaaaaatcatgtgaaaaaaatccaacaccctttcctgatagaaatgctcaacaaactaagaatggaagttaacttcctcaacccaataaagtacatgaattaatatcccacaactaacattatacttaaaaggtgaacaactataatttgtacacctaaaatcaggaacaagagaagaacatctgctctcaccacttttattcaatgttgtactaaagttttagccagggcaattaaattaaacataaatatatcggtttattttagaatgctcaattttattctattgatctttatgtctactcttatgcccaaaccatacaatcttgattactgtttcattatattaacttttgaaatcacaaacggtgagtctgctttgatttttcacaagattgttttgactattctgggttctttgcatttccctatgaatttttggatcagcttaatttctgcaaaaaaaaaaaaaaaaagtcagctggaatgttgatgtggattgcatcgaacccataggtcaatattgggattatttccatcttaacaatattatgttctgcaatccataaacaggagatgtcctctcacttattgttgctatctttaatttcaacaaatgttttgtacttttgcgtatgcaaatcttcacttcttttgttacatttatatataaatatctcttttatgttattggtaaatgaaattatttactcgattgcatttttggatagctcactgctaatgtacgaagatataattggtgttttactaatgtatgaagatataatattgatcttatatcctatgaacttgctgaatttggtattaactctaatagatttttttgtggattccttaagattttctatatacgagatcatttcatctacaaataggtacttttttcttaccaacctgagtgcctttcatttagttttcttgcctattttcaacaaggttgccaaaaaatttaatggggtaaagaatagccttttcaacaaatggtactgggacatctggatattcacttttaaaatatgaaactggattcctatttcacaccatatacaaaacttaattcaaaatagattaaaaacctaaataaaagaagtgaaacaataagactcttagaagaaaacacagcagtaaaatctttgtgaccttggattaggcaatgggatcttaaatatatatgtataacacaagcctcaaaaggggtaaaaatagataaatgggaatatatcaaattaaaattgtttgtgctccaaagaatactatcatgaaagttaaaggacaactcacagaacgagagaaaatatttttaactcatatatctgaaaagcatataggacccagaatatataaagaatttaacattagactataaaaagacaaccaaacattttttgttttttctttttttattattatactttaaactctgggatacatgtgcataacgtgcaggtttgttacataggtatacacgtgccattgtggtttgctgcacccatcaacccgtcatctaccttaggtatttctcataatgctatccctcccctagacccccaacccccaacaggcccaagcgtgtgatgttcccctccctgtgttcatgtgttctcattatttaactcccatttatgagtgagaacatgtggtgtttggttttctgttcctgtgttagtttgctgagaatgatggcttccagcttcatccatgtctctgcaaaggacataaactcatcttttttatggctgtacagtattccacggtacatatgtgccacattttctttatccagtctatcattgatgggcatttcagttggttccaagtctttgccattgtgaacagtgctgcaataaacatacgtgtacatgtgtctttatagtagaatgatttataaatcctttgggtatatacccagtaatgggattgctgggtcaaatggtatgtctggttcgagatccttgaggaattgccacactgtcttccacaatggttgaactaatttacactcccaccaacagtgtaaatgtgtccctatttctccacatcctctccagcatctgttgtttcctgacattttaatgattgccattccaacaggcatgaaatgttatctcattgtggttttgatttgcatttctctaatgaccagtgatgatgagctttttttcatatgtttgatggccacataaatgtcttcttttgagaagtgtctgttcatattctttgcccactttttgatgtagttgttttttttcttgtacatttgtttaaattccttgtagattctggatattagccctttgtcagatggatagattgcaaagatttttctcccattctgtaggttgcctgttcactctgatgatagtttcttttgctgtgcggaagctctttagtttaattagatcccatatgtcaattttggcttttgttgccattgcttttggtgtttttgttatgaagtctttgcccatgcctatgtcctaaatggtattgcctaggttttcttctagggtttttatggttttaagtcttacatttaagtctttaaccatcttgagttaatttttgtataaggtgtaaggaaggagtccagtttcagttttctgcatatggctagccagttttcccaaaaccatttattaaataggaaatcctttccccattgcttgtttttgtcaggcttgtcaaagatcagatggttgtagatgtatggcattatttctgaggcctctgttctgttccattggtctatataactgttttggtaccagtaccattctgttttgcttattgtagccttgtagtatagtttgaagtcaggtagcactatgcctccagctttgttccttttgcttaggattgtcttggctatatgggctcttttgtggttccatatgaaatttaaaatagttttttttaaattctgtcaagaaagtcaatggtagcttgatggggatggcattggatccataaattactttgggcagtatggccattttcacaatattgattcttcctctccatgagcatggaatgtttttccatttgtttgtgtcctctcttatttccttgagcagtggtttgtagttctccttgaagagatccttcacttcccttataagttttattcctaggtattttattctctttgtagcaactgtgaatgggaattcactcatgatttagctgtttgtctattattggtgtataggaatgcttgtgatttttgcacattgattttgtatcctgacactttgctgaagttgcttatcagcttaaggagatttttggctgagacgatggggttttctaaatatacaatcatgtcatctgcaaacagagacaatttgacttcctctcttcctattttaatagcctttatttctttctcttgcctcattgccctggccagaacttccaatactatgttgaataggagtggtgagagagggcatccttgtcttgtgccagttttcaaagggaatgcttccagcttttgcccattcggtatgatatcggctgtgggtttgtcataaatagctcttattattttgagatacgttccatcaatacctagtttattgataatttttagcatgaagcggtgttgaattttatcaaaagccttttctgcatcttttgagataatcatgtcatttttgtcatttgttctgtttatgtgatggtttatgtttactgattagtgtatgttgaaccagccatgcatcccagggatgaaggcgacttgatcatggtggataagctttttgatgtggtgctgggttcggtttgccagtattttattgaggattttcgcctcaatgttcatcagggatattggcctgaaattttctatttttgttgtgtctctgccaggttttggtatcaggatgatgctggcctcataaaatgcgtgaggaaggaatcgctctttttctattgtttgaaattgtttccgaaggaatggtaccagctcctctttgtacctctggtagaatatggctgtgaatctgttgggtcctgggcttttttttgttggtaggctattaattactgccttaatttcatacctggctattggtctattcagggttcgatttcttcctggttgggtcttgggagggtgtatgtggttcaggaatttatctctttcttctagattttctagtttaattgcagagaggtgtttatagtattctctgatggcagtttgtatttctgtgggatcagtggtgatatcccctttatcattttttattgtgtctacttgattcctctctcttttcttcttgattattctggctagcggtccatctattttgttaatcttttcaaaaaaccagctcctggattcattggtttattgaagggtttttcatgtctctatctccttcagttctgccctgatcttagttatttcttgtcttctgctagcttttgaatttgtttgctcttgcttttctagttcttttgattgtgatattagggtgttgattttagagctttcctgctttctcctgtgggcatttagtgctataaatttccctctcaacactgctttagctgtgtcccacagattctgatatgttctgtcttcgttctcatttgtttcaaagaacttatttatttctgccttaatttcattatttacccagtagtcattcaggagcagacaaccaaccttttaattaaaagttggcaaagaatttcaattgacatttctttaacaaaatagaaatgaccaataagaacatgaaaacatgctcaatcccaagagttattatgaaaatgcaaatcaaaatcacaattaggtaccacttaatactcacttggatggttatattaaaaaaagacaggcaattacaaacgttgtcaaggatatggagaaattgcaaacttcataaattgcagataggactataaaatgatgaagccattttagaaaatagttttccacataaagctaccattaaatccagtaattctactcctaagtatattctcaagttaatagaaaacttatgtccaaaaaatacttttacaggaaaatcatagccacattattcatagtagccccaaagtagaaacaatccaattgtccatcaatgtatacatgcataaacaaatgtgatatatccacacaatgggacattatttagcaatgaaaggcatgaagtactaatacacactacaacatggatgaaccctgaaaacatcatattaagtaaaagaagccagccacaaaggccacatattatatgattccacttacataaaatgtccagaataggcaaatgcataggaggagaatggagattagtgtttgccagaggttagggatgggggattgagaaggaggattgaggtaaggagtttcttttcaagtttcttttcagcgtgataaaagtatactgaaattggtagtcatgcttgagtaaccttgtgattttaataaaaataactgaattatacacttcaaaagaatacatgtacccctgaacttaataaaagttgatggaaaaaaaaagaatgaatcttatggtatgtgagtcatattttaacaaaaaattacagaaaaaattctgaccaaagtcaacagaatccagccatacattataagaaacaagagcaatggaattcattgtaggaatcaagaattgtttactatttggaaatctatttttaaaattgatcatattaactgatccaatgagaaaattatatgtcatctccatagatgctgcaaaggcatttgacaaaattcaatgacaaatctcaacttttaaaagttagtatgaataaaccaatgcttatttaacatgattaactgcatttatctcagccccaaattcagcatcatagggaaatacagcaagtgttaccattaaaatcagctagaagttaggaatgtccacagtcttcgctagtatttagcattatactgcatgcaatagctaataccattatgtaagataaggggaatcaaagtataaaaattagaaagaagaaaaaagtactatttttcattgaagatcatataattgtgtaaatggaaaatacaagagaatcaactgagaaaactatggcaagcaaacaatagttcagtaatgtagtggaatatatattaatatatgggatcaaaagtatctataacccatttacaatagactaatatcataaaatacctaggagtgaacttataaataagttcttaataagttcattatttttatgtataatacctacatatttattttttcttttttgtaaatcatctagtttatttcctggacacagcaggattgtttactttctgaatttcattttgttaccaataaccgatcttcatttttcatttgctatacttttgattgtggtaaaatatacataccataaaatttgccctcttattcatttttaagtacaatattcagtaggtttttttctttttttttctacttatttataatttcaacttttattttagattcaggggctacgtgtgcagatttgttacataggtatattatatgacactgaggtttggggtacaaataatctcatcacccaggtagtgggtatcatacacaataggtagtttttcagcttttgcttccctccctctctaccccctctagtagtccccagtgtcattgttcccatctttatgtctatatgtacacagtgcttagctcccacttacaagtgaggacatgggctatttggttttttgttcctgtgttaatttgcttaggataatggcctccagctgtatccctgttgctgcaaagaatgattttgttctttattatggctgcatagtattccatggcatatatgtaccacattttctttatccagttcaccattgatgggcacctaggttgattctatatctttgttattgtgagtagtgctgtaatgaacatataagtgcatgtgtctttttggtagaatgatttcttttgagtatatacccagtaatgggattgctgtgttaaatggtagttttgttttaagttgaggaatctctaaactgctttccacagtggctgaactaatttacattcccaccaacaatttataaatgttcccttttctctgcagccttgcctgcattggttgtttttgaactttttaataatagccattctgactgttgtgagatggtatctcattgtggttttgatttgcatttctctgattaaccatgttgagcatattttcaaatggttgtcagccacttgtatgtcttcttttgagaagtgtttgttcatgttttttgctcactctttaatggggttatttgttttttgcttgatgaattgtttaagtaccttatagattctggatattagaccatagtttgttaatattttctctcattctgcagtttgtctgtttactctgttggtagtttcttttgctctgaagcagctctttagtttaattaggtcccacttgtcaatttttgtttttgttgcaattgcttttgaggacttagtcataaattctttcccaaggctgatgtctagaatagtatttcctaggttttcccctaggattcttatagtttgaggtatcacatctaaatctttaactcatcttgagtaaatttttgtgtatggtgaaagttaggggattagtttcattcttctgaatatggatagccagctattccagcatcatttattgaatatggagtcatttccccattacttatttttgtcagctttgttgaagatcagatggctgaacgtgtgcagctttatttctgggttctctatttaagttcagtactgttgaagaaaactttaaaaaaatcaaaagagttcaataacacatggataggcctgccatgttccaatgtataaagattcagtgttccataacgtaaattattcccaagaaaatttgtaatgtggctcctataataacgctaacaggttatatctttaatctgggattagagagaagctaatttttaagtcatatggaaaaatacaaaaatatacaacaacaataccaaacaaaattctgaagaaaagaagcaatggggttatgttttgaatgtggcccaccctgacagatatcttcatgtgtgatgaattgcttatagtttccctgttgctcccctttgatatctgccttctgtcatgtcacccccatcttatcagtcaaatctgaaccccagctatatacagagttattttctcctccatgagagccctggacaaaattcatataaggaaacataatataatccctgtttaagtatccctgaacattctataatggggaggatttgtatactctgatcaaacagaaagcctcttagaggtgttgcttactgccaaaggctagcttattcaagttttagctctggcttcatgaagatacttataaactccaataatcaagaggtaaataagaggaagtgcaagacatttctactactatcatgaaccaggaccctgtaagcatcttctacactgggaaatattccatcattatttgtcatccaatataatctccctggtcaacaaaaagattctcccacaccaactgcaggaatcttgaatatttaaaagaagatgtgcctatgttagtgattttcttctgtttacaggtgaggcttcagacctttttcacaagtgcacatgttaaatatgcagtcaattctctatcctaatagacataaatgcacagcatcctgcctatcattcatactgagttgtgtgttaatttcaaaaagggatggattcccatttcaatgagcaaatggatttgtatgtgtgtataaggtgataggtaatctaaaggaaggctctgtaaatttagtatgtatatttttctctgtatgtgtaattaagctgttaaaaagaaatattttccttaatgtatctgttagcaagatgttaatgtacctcctgagatattttacttgttacttcatatacaacttaggttaaagtaaaaaagagcaacatattaatattgaacatgtaagaatcagttaaggtagattgtctaagattgcctgtgtgaatatgtgatgtaaaaatacttatggatattatgatcaactgttctaactttacagcctacaaatcattttacccagtttcatttttgttctttcttttcttttatctattctacttctccttcccactttgaattgaaatttggaaaatttaacacaggaaaagatttctggataaggtgaagagtaaagcagccattacttggagcttttctcaacataatgttttactaaaccttgaaggaaggtgatgattacactaccttatatatttaactcctgtctatcttacaaactaattacctgtggagttgttactaagtgatcaatctaataattcaatttagttcttaaggtgaccaaaaatctgaactgtgctcaatttctttttcttgattgccccatatcataatcaaacaagttgttatgtataataaaataataaagattgccccccaaatactgtcagtaatgctcttctgtcagtgtatgtctccactgaaaaaaaactctactctcatttgctatgtaattgcaaaacatgagcaaacaatatatgctttcatttaatgaccatcatatatttaagactgttgtttccaatgctttttatgtcatgcaaatatgcttcatacagctgtcacctcttccatgcttggtagctaaatgtcctgctgagctcttttgctctttttgatcaaataaagaccatcattttgttgtgaagttccatttgtcttttcctgcattgtagtatgaaacacctaaatgctctttccagctgctttaatttcctgatagtcattataaatctttggactctattctaaaactaaaaatagtttccttttaaaatccaacagaaaaatctgtcagaataccttattaggctcgcttccttgctcacctgccaaaaagatcataattatattgagggaaataaacatatagattaattgacctaatttgttaaaatttcaagagcacatcctgttgtgtgcaaactaaagagttgtttttacaaatgagcttcacaactattgacactacattataattttccctctttctatgaggtgataaaactatactaataaaggttcccaggcatatgtatagaaaataatatagaaatagtgagtaaccatatagtaaatgtgtaaaaagtacatgaaacatgcatgatgtattgagtgaaatcagaaacaaattaatcactctgccccattaacatttattcagagggagaaagatctttttttattatggataaaaacttggaaaatcccataacatttttagaacaatgttcttcagtcacttttagtgacaaaaatcaataattatatcttttcctgttgggaaataccaatataaaatgggaaaaaatgaggatgaactcttgatgttacatttgaattagaatatcgatacgaactcatgatttcttaaaagtgtatagtgtcctcatagtgcccattagcagagtgtagaagcaaaaccattggtagtaatgagtactcttagcaccagatcttggtttctaaataccattttccataaaagaaaatggagctccttgaaaaaataaacaattcccggtctggagcaggcaaggtacagataatcctgtataagaacattgagttgtgctagaaagcaagtattcagagaatgatggggcatgtcaaaaagttacacatcaaaaaagggccctcattgtccatatctggagcaatttgagcatcagaaaaaaatggtaatatcttgtaacatattagaaaataattaacgcgtccataatgacactcaaaaagagggtgggaagaaaagcttttctttacagatgaatgacagctaataaaatagaaggaatgatgtaaacaaaatcatcattttagaactacaaatataataattgattaaggcatgaatgcaacgttattggggaataggatattcacatagtttcaaagtattactctgtagattaaatactaaattacaaaggtaaaaaatgtacctttaaaatggacaaatctaggatttaccactttagatgcagataaaatattttgggcaggaacactatgcggctaatcttgtgtattttcaatcatgacattactgagtcaactggtagagaaataactttttaaaagaaagtaatatcccttacagatcatatatatggttttaaattatagatgaaagcaagggagtaataaacaaaattttggatagtgctcccttagaaggaaaagtaggtgttgtgatggggaaggcacataggcagcttaaagacactgatatttaatcacgtaaatggatggtcatatgcatgggtgttcattttgttattcttaaactgtacacatgcattaatatatgctctattttatgtatgacaaatttcagaaaaaacaaaggatgagccaatatctagcagaaaaactcacaaagataatttttaagaaaaattagaaactacatctttttttcaggcatatatgaaaatgaaaatttgatattttaattttttcattatactttaagttctgggatacatgtgcagaacatacaggttacataagtatacatgtgccatggtggtttgctacacctatcaacccgtcaactaggtttttgtcctaatgctctttttccccttacccctcaaccccctgacaggccctcgtatgtgatgttcccctccctatgtccatgtgttctcattgttcaactcccacttatgaatgagaagatgtggtgtttggttttctgttcctgtgttagtttgctgagaatgatggtttccagcttcatccatgtctcttcaaaggacatgaactcatcttttttatggctgcatagtatttcatggtgtatatgtgccatattttctttatccagtctatcattgatgggcatttgggttggttccaagtctttgctgtggtgaatactgcagcaataaacatacgtgtgcatgtgtctttatagtagaatgatttataatcctttgggtatatatccggtaatgggattgctgagtcaaatggtatttctggttctagatccttgaggaatcaccacactgtcttccacaatggttgaactaatttacactcccaccaacagtgtaaaagcgttcctatttctccacatcctctccagcatctgttgtttcctgactttttaatgattaccattctaactggtgtgagatggtatctcattgtggttttgatttgcatttctctaatgaccagtgatgatgagcttttttttcatatttttttgtccacgtgtcttcttttgagaagtgtctgttcatattctttgcccactttttgatggggttgtttttttcttgtaaatttgtttaaattccttgtagattctggatattagcccattgtcagatggatagattgcaaaaattttctcctattctgtaggttgtctgttcactctgatgatagtttcttttgctgtgcagaggctctttagtttaattagatcccatttgtcaattttggcttttgttgcaattgcttttggtgtttttgtcctgaagtcgttgtccatgcctatgtcctaaatggtattgcctaggttttcttctggggtttttatggttatataatcatttttataacatcccagctctaggcagggttaaagccttctcccataatctggattttgagattcccctgcggggatgtattttcagaggcaggtgctccctttctcgtactgcagcaacttagtttttctcttgtctcctggaaaatgctgtagtaatcagacaagagaaagaaataaaggccatccaaattagaaaactgggagtcaaactgttactgctcactgataatatgattatatacctagaaaaccctaaagactcatccaaaaagctcctagatctgataagtgaatccagtaaagtctcaggctacaaaatcaacgtacacaaattagtagcactgttctacaccaaaaatgaccaagatgagaatcaaatcaagaactcaatcccttttacaacagctgccaaaaaaattaaaaaggagttagaaatatatttaacaaaggaggtgagtgatctctacaaggaaagctacaaaacactgctgaaagaaatcatagacaacacaaacaaatggaaatacatcccatgttcatgaatgggtaaaataaatattgtgaaaatgaccatactgcccaaagcaatctacatattcaatgcaatttccatcaaaataccaacatcattcttcacagaactagaaaaaacaaccctaaaattcgtatggaatgaaaaagaacctgcatagccagagcaagactaagcaaaaagaagaaatcaggaggcatcactttatccaacttcaaattaatactgcaaggctatagttaacaaaacacatggtactggtataaaaataggcatgtagaccaatggaacagaaaagagaacccagaaataaagccaaatacttacagacaactgatctttgacaaagcatacaaaaacaagaagtagggaaaggacactctattcaacaaatggtgctgagataatcagcaagctacatgtagaagaatgaaactggatcctcatcttaccttatacaaaaatcaactcgagatagatcaaagagttaaacctaagacttaaaaccataaaaattctagaagacatcagaaaaattcttctagacaatggcttagacacaaatttcgtgaccaaaaccccaaaagcaaatgcaacaaaaacaaagatagatagatgggacttaattaaactaaaaagcttctgcacagctaaagaaataatcagcagattaaacagacaactcatatagtgggagaaaatattcacaaactatgcatctgcaaagactaatacccggaatctacaaggaattaaacaaatcagcaagattaaaaaaaatcccatctaaaagtgggcaaaggacatgaatagacaattctcaaagaagatatacaacgaaccaacaaacatgaaaaaatgttcaacatcactaattatcagggaaatataaattaaaaccacaatgagatatcaccttactcctgcaagtatgactataatttaaaaaatcaaaaaagaatagatgttggcatggacgtggtgaaaagggaacacttttaaattgctggtggaactgtaatctagttcaaccactatggaaaacagtatggagattctttaaagaactaaaagtagaacgaccattcaatccagcaatcccactactgggtatctactcaaaggaaaagaggtcattatatgaaaaagacacagcatacacatgtttatagcagtccaatttgcaattgcaaaaatatggaaccaacctaaatgcccatcaaccaaccagtgaataaaggaaatgtggtatatacacaccacatggaatactacttaaacataaaattgaatgaaataatggcctttccagcaacttggatggagctggaggcattattctatgtgaaatgactcaggaatggaaaactaaatatcatatgttttcacttataagcaagagctaagctatgaggatgcaaaggcataagaatgatagcatggaccttgaggacttggggggaagagtaggagtggagtgagggatagaagactacatattgggtacagtatatactgctcaggtgatgggtgcaccaaaatcccagaaatgaccactaaggaacttatctaaccagaagccaattgtacccccaaactattgaaaaaaaaaaaaaagagattgttatttctattaggtactttctcttgaatcactcaccatggagaaaccagctgtcatgtcatgaagacaccaaagcagctctatggagaggtggtaagaaactgaggtctcctgatgacaatcagaactaacttgtcagtcatgtgaatgaactgccttggaaatgagttctccaggcccagtcaaacctttagacgcctgcagacacagtgacattcttgactacaacatcatgagaaactgagctaaaatgacccagttaaggcattcccagattcctgacccacagaaattgtgtacatttaattgttttaaactgttaagttttggtgtacgtttggtgtaaaattttggtgtaatttgttatgaagctgtagagtacaggattttgatctatagcctttgttcagttttcacttagtttctgtctattcttagagttcccctattctcctaagattccagtcaatagactgtcccattcagttatttaagattcttattatcttggattttagttgatttctgctcagctgtagtcaccaagtcctggcaccaataatttctgctccttccaaactgagtcaatctagaccaagacagggaggtagaatagactgtttccttttaccagtgagtaggctctaactattctattttggtgccttttatggcatggatgaaaccttcagcctcctctccctaactcttgtcatgtttacatggatgatagttcttggactggaatagagctataactctggcttgaacccaacttgtttagctgggtcccaacactctaaatctgagtttgaatcccagctctaccactaattggcatatgatttaaataagtgatttaatttctctgtacttactggtttttcaactctaaaatatggataggtcttactttacagagttgtaaggagaaaatgagatcatatatgtgaagttcttagcccagtgtgtgtgggaatgaatctttcatgtgccatttaaatccataatatagctaccattttgactctaaattttgcactgctaaaaaaactcacactactggacccttccaacagactaaacctccttggatactaatttcaatccacttaaagttttaatttaacactattctttgaacatcatgatcttaaatctatagtccaccctctatacaagatagttactcaaatcctggtcttttcccctttgtcagtagccatccctagaattcccaaaatgtggtcaatttttttctgtgttttcacaacctggggcttcactgtgatttttaaaaagaaatattatttttctgcaggtattatatatgttgctttgtctgatcagaatactttcctttggtaaacagcccatttcttactccacataattctgatgggctgttacttacaagactctgctccatacaagaccatagggtgggtatgtgacctaagctaggcttatccgatgtttttttcctgctaattttattgttgagtggttgtacatagaaactaaggtgatgagacctatgagtttaaatggaagcaccctgtagagatggtgctggaataactaactaagatatttaaaattgctctggttctttttctttgtgaggcctgatttctctaatcgtcctttgctgtagtgacagacactatatccatcccataaatttcttttttatgatttaatctagtcagagttatattttaatgctttcaaaatttatttttgaaaaagtttgcaaaacataacattcattgtaaaaatattggaaaatatagatttgtatagctaaaatattggaaatcacccatatttccgctatctagggagatctaccattttgtattacaatgcctactgctttatttcacttaacattatgtcataagatttttctacagcatttcgcttcataaatataatgaggttgcttgttttcctttgtatgtatatgccataattcatttaattgttttattatcattggatattttgttttttttccagatttttgtattttaaaaattcctgcaatggaatgtctgcacataaatttttgttttcattgtgaattactttttttttttgtagtgtgttgattgagctaaactccatctagattttctttatttcatttctagactcctttgatctagaagtggtcatttgacatactttagaacagtgaaatggaagcagaagttgctgggtgagacttttgtgaaagatttttaagaggctcagagttcttctggcatacctccttttccaaatcaaacaatgataataataatggaaggatgaagggcctttatctgctacttttactgtgctgaaaacactctccttactatgctgtcctctgtatgagttctctcagctatcttctctgcctaaataaaagctttaggccacctagcctaaaagtccctgaccttacctttagttacacagtcaatgattttactacctacatcttactttcctgctatccaccacaaggatcaactatgccccacctctttgcattcttattgtcctgactctggcctgcataatagaggaaaggaaggtcagaatgtgaaaagaataagtacagcttagtaattaacagcatgttctctggagcccaattgatttttatcctggctttgtcatcagcaattttcttaatctccctgtttctcagtttccttatctataaaatgcggaaaataattgtagtcacttcacaggattgttatgaggactaagcaagttaataattagaaaacacatgtattaggtgctgcatgaatgtttataaaatcctccatctctttctgtctgatctaccatcctcaaattaaaaagaataaaaagaagaaagaaaagaaaaccaacagcaccactgtgttaattactgctcccatggcttgcagacttgaagattttctattctggtgttcttgctatgtaaaacaaaacaaagaacacaaaacattctcacaatttctctatctcattcaagactgctcatctttactgatccactgttagcagacatgcagtccccccaccccttgcttagaaatgggtttgttcagctcaaccagcagaaattctcctcttcttttgatcagtagcccatgtttgtgagtggttaaatgaagacaggggtacattttttctaaattaaattttatctacccttactccacatataatgcagtggatctgagacatttcatatttacaaaaggcactttgtaaatacttccctaccattactgaaatagttgatattttaattttactgtccgtgactgtgcctactttttaaaaaaggccagattgaaaattattaataaagtccttagggccatcaaatggataatataatggtagcactgcttattggatcaattgtgtcattcaagagaaacaacaataaaaatagaatcaaatagatagagggggagaagttggtaagaccattcttaacatttgcatgacacagaattttccatcataagttattacagaaatggtgaaattccttatgatttgatgaatttttgttttaagaaaatatgtatttaattaaatgaatcttgttgttcttaaaatattttctctgatccagatgataagttcacatatatgccagctacaagaatcattgtttttgtggttgatctattcgtaaagagtcactacaaataatatttcttatatttgaatctttagaggtggcacaagggcaaaattacctgttaaccaacattccttcatttagaagtgataacttttcccattttaacaaaattttatctgaagaaaaaaaatggatgaatgtaatgtcattcactttaagatatttagatttctagttaataagatctttttttatccattaactacttgaaatgtctaatattcattcattcaaaaaacttttattggttcttgcaatatgtaaggcatagggaaaacacaaataacaaagacagacaatatttagctataatagcttcttcccagataattggaaaaatttcacactttagtaataaggcttgtattcatgaagatcacaaattttctcaataaacatatatatcttgctttattagcaattaataaaattatcttaatgtataaaacaaaaaagtttctcatcagcaatgagtaacacctaaaatgtctatacgctataattactttagctgtagaatatagacaattaaaaataatctcctcctatgtttaaaatgatctctatgttgagaaaattaaatatttaacaatcaatatactttcagaagtacaacggtaaagttatacctagagagaccaaaaataaaaatacaagcatgtcatcaatggtatgacttctttgtgaatgctccacagacttaaaatacaaaagacaaaaacttccccaaagcacaattttaaaataaagcagtttagaataatcttagcgccattgatctgtcccctctttcacatcaaacacagtcacaagacgcctacatcctgaaatcatctttcaccaaactgacagatttaatggatcacatattctgagtttaagtgacctattttgtcttatgttttctttgggatttagaaaacaaatgtaatgtaactatatatacttacctttcagtttcaggacataacaggtcaattgccaacatttcttacaggaagaaactgataaactcacaaactttgtaaggctatctttaaaataaaattcaccccatctttttcacatttattttgttaattttattcttacttctcacttgctcatagattttctaaataccaaattgccacgtgagacctcactggttgactgtaaaatctgtaaagccacaaaacttaaaaaatgtcccttgacaataataaatcctcaaaaattcagcaataccaattgcttttcccattcaccttgctgatagcaaagaatatttatgaaagatttcttagactgtgagacctttagcacgtcagttccattcaatatagttagcattccataatagtcaactatttccagacacagtttctaaaatcgcagcaaaagccccttggaaaaatatttggtttcttatactttttatttttaaaaatatgataactagcaaaaacaaacaaaatcgctgtccaggatggtgtttcatataagcacttattgtatgtctcctcttcagactagaaatagtgtaataacaataaaaatggaattctgtaaataatttctaaagagtcagagtaacaatgaaaaacaaaggtttacaataagaggaattagctggtttagaaattttttagtatgaatggatttgtcttagtagcaacattttttggcctcttcaaaaattcagtattattactctcagacattttttaaaaattaagtaggaattcacaatacacttctctaatctatttttaaattaatctgtggaaagtgaataaacacagcaagagtccaatgtcagtcatgagggagtaagaatttgacggttccgaatactggaggccaaaacacaaggtcattgagcagattttctaaaaatgtcaataattctcagactatctctgcaatacttatatgcattatatgttctagaccagtggatctcaatattcaggtctcgaccagcagcatcaacatcacttgggaaattgctagaaatgcaaattatgaagtctctcatcagatgggctgagttggaaactctgtgggtggcactcagccatctctctctttctctcttgtaataattccaacttttattttagattcagggatacaagtgcaagtttgttccatgcaactattgtgtgagattgagatttggggtgtgaatgattccatcatctgagtagaaagcacagtacccagtaggtagtttttcagcgcttgcccctctccctcctcctttgggagtcctcattgtcaattattcccatctttatgtccatgtgtacccaatgtttagctcctgcttgtaagtgagaacatgtgatatttggttttctgtttctacattaatttgcttagcataatggcctccagttgaaacagtgttgctgcaaagggcacacttttgttctttattatggctgcatagtattccatggtgtatatgtaccacattttctttatccaatccactgttgatgggcacctagtttgatttgatgcctttactatcatgagtagtccagaaatctgttttaacaaacccttcaggtgattctgatgcacactaaagtttgataatcatcacagaatgttacatttaattttcagcagttgtaaacttaactcatcatggaatgaactttttacaaatgttgtattgtgtatgtattataaggacattacaatagcgtaatgaggtgaaacttcaactttaaatgtatcataatataagaactgaattatgccctttttctttaccagtttgattatttttccttccctcttctatctacctctaaacaggagattatgttaattttcccattgaagtcctttaatggttgcctatctcactcgaagtaaaagctactctcctcataatggcctacaagtccatgcaggatctgctgcccactttcccctcctcattatttctctgacctcatctttttccacatctgcactcattccttcaacatcagctatagtacccttctcacagctcttcataattgccaaacatactctcgtatcagagaccttgaatctactgttccctctgtctgtcgacactcttccttcagacatttgtgtagctgactttatgttttattcctcctttgggtctttgctccaatgtttctttcttgatgatgccttccctggccaccctttctaaaactgcaatgttctctccattctcttgtcccaattgactgctatattttcctccttggcattttatatctattcttggaatatattctgtttacatcttttatggaagtatgtccccactagaatgcacactagtgacagccatgatttcaatcagttttattcaccgctgactaccaagtggctaaaacagtacctgacacaaggttggatttgatacatacttggaagatgaaggaagtaagaaaagagggaaggaggaagggagggaaaagagaaggagggaagataacttggtaaggttcctctacttgttagagctactctccacttggcataactatattttctatatagtatcaaaattctctttttgcctaaatatctcaaatatatgcttatatttataatctttgctacttatctatcaagtagtttccttgtaatctttctacaatattgatttcttccttacattttaactaaaactgaatgccatcttgtctaattttaataagatcataatctatgttttctttttttcttccccaaataagtttatccattattttcttttctttcttttctttaattttattatattttattttaagttctgggatacacgtgcaggatgcgcaggtttgttacacaggtaaacatgtgccatggtggtttgctgcacctatcaacccatcaccttggtattaagccctgaatgtgttagctatttatcctgatgctctccctccccctacgccccatgacaggccccagtgtttgttgctcctctccgtgtgtccatgtgttctcattgttcagctcccacttataagtgagaacatgcggtgtttggttttctgttcctgtgttagtttgctgaggataatggcttccaggtccatccatgtccctacaaaggacattatctcattcctttttatagctgtgtagtattccatggtgtatatgtaccacatttttcttatccagtctatcattgatgagcatttgggttgattccatgtctttgctattgtgaatagtgttgcaatgaacatacttatgcatgtatccttatgacagaattatttatattcctttgagtatatacctagtaatgggattgctgggtcaaatggtatttctggttctaggtctttgaggaatcaccacactgtcttctgcaatggtttaactaatttacactcccaccaacagtgtaaaatctttcctattattgcactattgcactccagcctggccaaaaagagcaaaactctgtctcaaaaaaaaaaaaaaaaaaaagcattcctatttttccacagcctctccagcatctgttatttcttgactttttaataatcaccattctgacttgcatgagatggtatctcattgtggttttgatttgcatttcttgaatgatcagtgacggtgagcttagagaaccaagagcaaacaaacccaaaagctagcagaagacaagaaacaaccaagatcagagtggaattgaaggagatagagacattaaaaacacttcaaaaaatcaatgaatccaagagctggttttttgaaaaacttaataaaatagacagatcattggctagactaataaagaagaaaagagagaagaatcaaatcgacacaaaaaagaatgataaaggggatattaccactgaccccacagaaatacaaataatcatcagcgaatactataaacacctctatgcaaataaactagaaaatctatatatatactagaagaaatggataaattccttgacacatacaccctcccaagactaaacatggaagaagttgaaatcctgaatagaccaataacggttctgaaattgaggcagtaataagtagcctaccaaccaaaaaaaaaaaaaaaaaaaaaaaaagcccaggaccagatagatttacagctgaattctaccagatgtacaaagaggagctggtatcatttcttctgaaactatcccaaacaactgaaaaagagggacttctccctaactcattttatgaggccagcatcatcctgataccaaaacctggcagagatacaacaaaaaagcaaaacttcaggcctatatccctgagaaacattgatgcaaaaatcctcaataaaatactggcaaactgaatccagctgcacatcaaaaagcttatctaccatgatcaagtcagcttcatccccgggatgcaaggctggttcaacatatgtaaatcaataaacataattcatcacataaacagaagtagagacaaaaaccacgtgattatctcaatagacacagaaaaggccttcgataaaattcagcatcccttcatgttacaaactttcaataaactaggtattgatggaatatatgtcaaaataatgagagccacttatgataaacccacaaccaacatcatactgaatggacaaaagctggaagcattccccttgaaaactggcacaacacaaggatgccctcactcaccacttctagtcaacatagtattgaaacttctggccaaggcaattaggcaagagaaagaaataaaggatattcaaattggaagagaggaagttaaactgtttctgtttacagataacaagatcctgtatttagaaaaccccatctctcagccgaaaagctccttaagctgaaaagcaacttcagcaaagtctcaggataaaaaatcaatgtgcagaaatcataagcattcctatacaccaaaaacagacaagtagagagccaaatcatgaatgaactcccattcacaattgtcacaaagagattaaaatacctaggaatacagctaataagggaagtgaaggacctcttcacgaagagctacaaaccactgctcaaggaaataagagaagacacaaatggaaaaactttccatgctcatggataggaagaataaatatcataaaaatggtcatactgccaaagtaatttatggattcagtgctattcccatttaacaaccattgacattcttcttcacagaattagaaaaaaaaaaagctttaaaattcatctaaaaccaaaaaaagagctcatatagccaagacaagccttagcaaaaagaacaaagctggaagcatcacgttaacttacttcaaactacactacaaggctacagtaaccaaaacagcatggtactggtacaaaaacagacatatagaccaatggagcagaaaagatatctcagaaataagactgcacatctacaatgatctgtcttcaacaaacctgacaaaaacagacaatggggaaaggattccctattagataaatgctgctgggaaaactggctagccatgtgcagaaaattaaaactggacctcttccttttaccttataaaaaattaactcaatagattaaaggcttaaatgtaagaccctaaaatataaaaactctagaagaaaatctaagcaataggtcaggtacggtggctcatgcctgtaatcccagcactctgggaggctgaggcaggtggatcacctgaggtgaggagttcaagaccagcctggccaacatggtgaaaccctgtctctactaaaaaaaaatagaaaaaaaaaaaattatctgggtgtggtggtggggacctgtaatcccacctactggagaggctgaggcaggataattgcttgaactcaggaggtggaggttgcagtgagctgagatcacgccattgcactccagggtaacaagagcaaaaccctgtctgaaaaaacaaacaaacaagcaaacaaaaggaaatctaggcaataactttcaggacataggcacgggcaaagatttcataacagaaacaccaaaagcaattgcaaccaaagcaaaaattgacaaatgggagctaattaaactaaagagctgcacagcaaaagaaactatcatcagagtgaacagacaacctacagaatgggagaaaatgtttgcaatgtatccatctgaagaaggtctaatattcagaatctataaggaacgtaaacaaatttacaagaagaaaacaaacaactccattcaaaggtgggcaaaggatatgaacagacactgaccccacagaaatgcaaataatcatcagagaatactataaacacctctatgcaaataaagtagaaaatctagaagaaatggataaattcttggacacatacatcctcccaaagctaaacaaggggtttatattattttcaatctgtcttaataactgtgtttgatgtgtatttcttgtataaaaattgagttggatttatttttcaggtataatcaaaaatcatttttttaattggtaagtttagtcaattcatatttattgatatgacatattttgtatatttttattttcataaagtctttcacaatgttatctgtttttttgctttattttaaatttatagttttaaaaaactttattttaccatgttaagaacacttaacatgagatctaccctcaacaaatttttaagtgtacaatagaatattgttgactatggggtcaaagttgtatagcagatctctggaatttattcatcttgtgtaattgagactttatgcacatttactagcaactccacatttctcccttccccaggttcctggaagccaccattctactctctgattccatgagtttgaatattttaggtacctcatataattgaaatcatgtgtatatgtacttctgtgactggcttatttcacttagcatagtatcctcaagattcatccatgttgttgcatatttcaggatttccttcttttttaaggcttaataatattccattgtatgcatataccatattttctttattcatttattcattgatggacatttaggttgtttcaatatctttgttattgtgaataatgctgcaatgaacattggagtgctactatctctttgagatcctgatttccattcttttggataaatacccagaagtagaatttctggatcatatagtcgttctatttttgatttttgtggaattgctatatgttttccatagtggctatgccattctgcattctcaccaacagtctacaagggttccaatttcttcacattcttggtaacacatttttggtaacacttgttgtctttttaaaaataataccttaggtcctaacagatgtgaggtggtgtcttaacccattgtggtttctatttgtatttttttgatgaatagtgacattgaacatcttttcatatacatgttggacatttctaggtcttctttggagaaatttctactcaaatctctagctcacttttataactggggtatttattgttttgctatttgagttttatgagctccttacatagtttggaaattaaactcttatttgatatatgctttgcaaatatcttctccccttctgtaggttgccttttcactcttgtttcctctgctctacagaaactttttagtttgatgaagtgccacttgtttatttttgttttcattacctgttctttttgagtcatatccaaaaaaatctttactaagatcagtctcatgaagctttatccctaagttttctttttagagtttcaggtcttatatttaagtatttaatccattttcagttgattttttgtatagcataagataaggatctaatttcatccttttcactatagatatctagttttcccaacactatttgttgaagagactatttttcccccttatgtattgttggtatcctgttaaagatcagttgaatcttatatttgtgaattgatttctggactctattttgtttcattggtttatatgtctgtgtttatgtcagttccctaatgttttaactactgcacctttgtaacatattttaaaaccaggaagtgtgatgcctccaggtttgttctactttctcaagattgtcttggttatttaagatgttttgtggttccatataaattttagtattatgttttctatttatataaaaaatgccattgaaattttgatagagatttcattgattttgtatcactttgagtagcatggatattttaacaatattaagtcttccagtacatgaacacagaatatctttctgtatgtctgtgtctactttaattactttcatcagtgttttctagttttgagtctacaagtctttcacattcttagccaagttcatacctgagtattttattatttttggtgctattgtacatggatatctttcttaatttccttttcagatagtttattgttaatgtcttgaaacacaaccaatttttgcacgttgattttgtatgctgtaatgttactgaatttgtttattaattttaacagtttatttgcgaactatttaggatattctacatatgagattgtgtcatctgtaaacagggacaattttacttcttcctttttggtttatatgcctctcatttctttttcttgcctaattgctctggctaggacttccagtactatgttgaattgaagtggtgagagtggacatccttgccttcttgatcttaaaggaaaagcttttagtttttcaccattgagtatgaaattagctgtggaattttcaaatatggcctttattatgttgaggtaatatctttctattcctagtttgttgagagtttttataatgaaagggtgttgaattctgtcaaatgctttttctgcatttattcacatgatcatttgattttatactttgttctgtcaatgcaatgtatcagattaattgattttcacatattgaaccatccttatatcccatagatgttcatataattattcatagtcatctcctatgatttttatttttctgacatcagttgtgatctgacattttcacttatgatttaattcatttgagtcttctccattttctcttagtttagctaaaagtttagcattttttctgaacttttcaaaaataactcttaaatttgttgattattttctattgttttatattttctatttcatttatctctgctgttatctttatttccctccttctgataacgttgggcttaacttttttcctttctgtagttccttcaggtataacattagactgtttaatatatttcttctttttcaacatagatgttttttgctataaagttctgctatggtctgaatgtttgggtccctccaaaatttacatgctgaaatcctaagccccaaagtgatggtattaggacataggacattggagaggtaattaggtaatgagggtggtacctttattaatggaattagtgtccatatgaaacacaacctggagtgctcatccccttcccacccaacatgggagtctgcagcaaaaagacagccatgtaggaagtggcccttgccagacactgaatatgccagtgcctggatgctggaatttccagcctttagaactgtgagaaatttttgtttataagcaacacagttttttgctattgttgttacagcagcctgaatggactaagacaacttcctggttagtaatgactttgttgtacccaaaagttttggtatgttgtattttcattttcatttgtctcaaagtatttcctaatgtttcttttgatttcttcattgacccattgattgttcaaatgtgtattgtttaactttcacatatttttaaattttccagtttttcttctgctattgatttcattcccttgtgataaatacagattcttggtacgactttaattttcttaaatttgttaagacttattttatgacttaacatgtgatcttttctggagaatatctgatcctctggacaatgatatatattctgctggtgttgggtgaaatgttctatatgtgtctatgaagtccatttggtctacagttttggtcaaatctgctgtttctttgctgattttttgtctaaccctaaccctaatccctatccattactgaaagtaggatattgaagtcccctactactgtaatattatggtattgctatccatttctcccctcagttctgtcaatgttttcttaatatatttaggtgacctgatgttggatgtatataaatttatattgttatgtcttgctggtgaattgaccccttttttattatataatgcccatcttcatctcttgtgacagttttgacttaaagtctattttgtctgatagccattcctgctctcttttggttgatctttacataaaatatctttcactatctcttcactttcaggttgtgtgtccttaaatcagaagtgagtttcgtgtagacagcatacagttagattttatttgttaatcttttcaaccattctatatctttggattgagaattttaagtcatttacacataaagtaattattattattatttatttccataggttattggggaacacgtggcgtttggttacataagttctttagtggtgatttgtgagattttggtgcacccatcacccgagcagtatatactgcacactatttgtagtcttctatccctcaccctcttcttaccctttccccgagtccccaaagtccattgtgtcattcttatgccttttcatcctcatagcttagctcccacttatgagtgagaacatacgatgtttgattttccattgctgagttacttcacttagaataatagtctccaatctcatccaggtcactacaaatgccatcaattcattcttttttatgactgagtagtattccgacatatacatatatatatatatatatatatgtcatatatatatatgtcatatatatatatgtcatatatatatatgtcatatatatgtcatatatatgtcatatatatatgtatgtatacatacacaccatagtttctttgtacactcattgattgataggcatttgggttggtttcacatttttgcaactgtaaattgtgctgctgtaaacgtgtgtccaagtatctttttcatataatgacttcttttcctctgggtaaatacccagtagtgggattgctggatcaaatggtagttctagttttagttctttaaggaatcttcacactgttttccatagaggttgtactagtttacattcccaccagcagtgcagaagtgttccctgttcaccgaagccatgccaacatccactatttttaaattttttgattatggccactcttgcaggagtaaggtggtatcacattgtggttttcatttgcatttccctgatcattagtgatgttaagcattttttcacgtttgttggccatttgtatatcttcctttgagaattgtctattcatgtcctcagcccattttttgatgggattgtttattttttcttgttgatttgagctcattgtacattctggatattaatcctttgtcagatgtatagattgtgaagatttttttcccactctttgggttgtctgtttactctgttgactgtttcttttgccatgcaaaagctgtttagtttacttaagtcccagcaatttatctttgtttttattgcatttgcttttgggctctttgtcataaaatccttgcctaagccaatgtctagaagagtttttccaatgctaacgtctataatttttgtagtttcaggtcttagatttaagtccttaatccatcttgagttgatttttatttcaggtgacagatgaggatccagtttcacgctcctacatgtggcttgccaattataccagcagcatttgttgaagagggtgtcctttccccactttgtatttttgtttgctttgtcaaagatcagttggctgtaagtatttgggtttatttctggcttctctattctgttccattggtctgtgtgcctatttttatatcagtaccatgctgttttggtgactatggccttatagtatagtttgaaatcaggtaatttgatgcctccagatttgttctctttgcttagtcttcctttggctatggaggttcttttatggttcttctccagaactcttctccagctcattctatgaggccagcattatcctgataccaaaacatgacagagtcacaacaaaaaaagaaaacttcaggccaatatctttgatgaacatagatgtgaaaatcctcaacaaaatactagcatgttaaaaaaccttcaacaaataaggcattgaaagaatatacctcaagctaataagagccatctatgacaaacccatagccaaaatcatattagatgagcaaaagctggaagccttccctttgagaaccagaagaagacaagaatccccattctcaccactcctattcaacataatactggaagtcctagccagatcaatcaagaaagagaaagaaataaaaggcatccagatacgaaaaaagaagtcaaactatctctgtttgcagacaatataattctatacctggaaaaccccatggtctctgcccaaaactttctgataacttcagcaaagttttgggatacacatcaatgtacaaaaatcagtagcatttctatacacaaacagcatccaagctgagagccaaataaaaaatgcagtcacactcacaaaagccacaagaagattaaaatacctcagaaaacagctaaccaggggttgaaagatctctacaatgagaattacaaaacattgctgaaagaaatcagagatgacacaaatggaaaaatattccatgctcatgtactgaaagaatcaacatcattaaaatggctatactgctcaaagcaatttacacattgaatgctattcctatcaaactgccaatggcattcttcacagaattagaaaaaattattttaaaatttgtgtggaaccaaaaaggagcccaaatagccaaaaataaccaaagcaatcataaggtggggggaagctggaaggatcacatttcccatcttcaaacaatactaaaaggctacagtaaacaaaaaagcatggtactgtacaaaaacagacacacagactaatagaacagaacagagagccagaaataaagctatgcacctacaactgacggatctttgacaaagtcgaccaaaacaagcaacggggaaaggacttcctattaaataaatggtgctgggataaccagccagccatatataaaagattgaaagtggactgtttccttataccatttacaaaagtcatctcaagttagattaaaaaagtaaatataaaacctaaaaatataaaaagaaacactggaagataatctgggaaataccattctggacataggcctttgcgaaggttttataatgatatctccaaaagccactgcaaccaaaacaaaaattgacaaatgagatctaattaaactaaagattttctgcacagctaaagaaactatcaacagagtaaacagacaacccacagaatgggagaaatatttgcaaactgtgcatctgacaaaggcctaatatacagaaactctaaggaacttaaattgataagcaaaaagcaaacaactttaaaaaagtggacagaggacattaacaaacacttttcaaaagaagacatatggatggccaacaagcgtatgaaaaaatgctcaacatcactattcattagagaaatgcaaattaaagccacaatgagaaaccatctcataccagtcagaatggatattattaaaaagtcaaacaattatagatgctcgcaaggttgtggaaaaatgatcacttatacactactggtggtaatataaattagtttaaccattgtagaaagcattttggtgatttttcaaggaacttaaaatagaactaccatttatcccagcaatcctattaaatcccattattgggtacatacccagaggaatataaataattctaccataacaacatatgcacgtgtatgtttatcacagcactattcacgatagcaaaggtgtagaatcaacctagatgcccatgagtggtggaccggataaaggaaatgtggtacatatacaccatggaatactatgcagccatacaaaagaacacaattatgtacattgcagcaacatggatgcagctggaggtcattctcctaagcaaactaacataggagcagaaaccgagtatcacatgttctcacttgtaaaagggagctaaacattaggtacacatggacacacagaagggaacaacagatactgggggctccttgaggatggaggatcaaaaaagtacctattgggcactatgtttattacatgggcaataaaataatctgttcaccaaacccccataacatgaaatttacttatatacaaacctgcacgtatgcccctgaatctaaaataaatgtagaaagaaagcaaaatagtgaaaataaaaagaaaaacaaataaataaataaacttacaaataaaggcagatctttagaataaattaccagcaacaacacaataattggttatgggcaagtagagttgattccaggaattttaagctttttaaaatcaggtaagatatcaacataatccattaattacattagtatatttaagataaaaatgagaaaccaatcgattatgcttagaagtcattaataataaatccccaagtaaactgttaatagaaggaaatcatttaaatataatgtgggctattaaagaaaaaattatttaaaataaaaattaaagtatttaaaaattcttacaaatgcattaagaaaaaataaaatagaagatttgaacattaatatttaatggactatatgtatacttgtacatatatgtgtatatatatgcatatgtgtattcccttgcatttaacatttggagggcataccttttatttttaagaacacatggaacaatcataagaattgaatacatattaaatcataaagaagctggcaaaaattttagagtgtagggatgtggagaataaaagtctccacagatcatccccccattcaaggacactcatttaacaactgtctacacagaaaaatcaccttcataaaaatcaaaaatcaggtgagcactcatagtgtctggttttaacttcatatcactgaaagaggcactgaagagacaaaacaaaagaaacaaacaaagaaacagtcctgaattgctggcaccatccctcccccaccacccagtagaagcagcatgacgcagagagcatctctggtcactgggggagggagagcacagcaatcgtgaggcattgaacttagagctgctgtgttagagcagaaaggaaaaccggaccaaactcagttgatgactgcccatggagtgaccatttaaaccagctgtagtcacaggggatttgctgatcccagtaactgaaacttgaattcctgcaaacctcatcaccacaggctacagtgctctggatctcttagtaaaattgaaaggcaggcttggccacaatgactgcaactcttaggcaagtcctagtgctgaactaggccgagagacggtggactgtggtggggcacaggacctactgagacacaagctaggatgactctggggttactggtattatccctcccctaaatcaggctgcaaagctcatgactccaagagacccctttttttctgcttgagaggagagggaagagtggggagaacattgtcttgcatcttgcaaggataaagcaggataaagtattggttagagttgtgaggtccccattccaggccctagcaccagatgacatttgtagacatacccttggccagaataaaacaaaaaacaaaactgctgccttgaaggaaaggatccagtaatggcagcattaatcacctgctaagtcaagagcccttgggccctgaataatcagcagtgatatccacacacttcactgaaggtcttgggtgaacctcttatatatgttggcttcaggtgagactcagcacattaccagctgtggtggctatggagtaaaatgccttctgcttgacaaaagaagagggaaaagtaaagaggactttgttttctaccttaggtaccagcatgactacatggggctaaaagtaccatgtggggatcttgggggtccccgattttagaacttgactcttggacagcatttttggacatatcctgggccagaggggagcccactgccttgaaggatgagtaccaggccaggcagcattcaccaaaagctgatttaagagctctatggcccttcaggaaaaattggctggtaaactggtagtaccagcctggggtggcggtggctacaaggtgaggctttgctgcctttggaaaggaaagggaagagtggaaagaactgtgtcttgtggtttgagtgccagcacagccatagcacaatataacaccatgtagacttctaaggattttgactctagtccctgaatcctgatggcacctctggacccacctggggcctgggggaactcgctgccctgaagggaaggacagaggcttggctgattttgctacttgctgattgtagacccccagggccctgagcaaacaagggcactttccagggagtggttacaaaaggccttgggtgagaccaagtgctgtgatggctttgggtctgaccccagtgcagccatagtggtcatggccacaggtgagcttgtgtcactccaccctcagctttagatggctcaaaacagagagaaagactctatttgttggggggaaagtaagggaggagaacaagaatctctgcctagtaatccagagaattctcccggaacttgtccaagacaatcaaggcagtatctctatgagtctctaagaaccacagcattactgggcttggggtgcctcctaaagcacacacaacttagatcacaacaccaaagccctttagaatatttggaaagccttcctaagaaggatgggtacaaatgaggccaaacagtgaagactaaaataaataagacatactatttgatagtcaataataatttaattgtacaatttaaaataactaaaagagtgtaatttgattgcttgtaatacaaaaaataaatgcttgaggggatgaatatcccatcttccatcatgtgattatttcacattgcatgcctggatcaaaacatttcatgtgctccataaatatatatacctactatgtactcacagaaattaaaaatttaaaaatttttaaaaattcagaattgatattgggtagattattttctaaggacaatgcaagtaatttggattatcaataagaaaaagaataagaaaggaccttgatattttcagacattaaaatgcacttcaaaatcactcatgggacaaataagaaattataacaaaaaattaaaatactggccaggcatggtggctcatacctgtaatcccagcactttgaaaagccaaagcgggtggatcacctgaggtcaggagttcaagaccagcctggccaacatggtgaaacccttctctactaaaaatacaaaaattagctgagcgtggtggcaggtgcctgtaatcccagctactcgagaggctgaggcaggagaatcacttgaacctgggaggcagaggttgcagtgatccgagatcacgccattgcactccagcctgcgcgacaagggcaaaactccgcctcaaaaaaaaaaaaaattaaaatacttaggcataaacaacaataataataaagcaaaacttttgaatgaagccaaaatgcctttttccagtctcttaagctgtaatattcaaggtcttcatgtttattcctgcctctacacctttgctagtgctaattactgccacccccgaaaagatcatttttttagttcaaattttctgaagttcacctgcagtttcactttgtttgtgaagacttagcatccacttgtttgctaattatttctcatattaattttggatcccaaactggttggtaaggtttttgaggggacagggatcttgctttatttatatactttgcattttccatagcacaatgttaagcatcacccattcccatctctgtgcctactatttgggttcaaaaaaggcttttgaatgacttatgaaattatttaataccttgcaatgaattattccagtattgtttaggacattgtatcatggaacaatattgctacatagtctgctggctttaatatcttgcttcattcctcttcaaaacaagatttatgatgtagaaaactatttgtgatttaaattcaaggttttaatttgaaaataacatctgtatttttttgctaagtatactattagcaacttgagctttttgtgggggtatgaggtgtaaaattgtgcttaacatgaagtgacaaaaaaaaaactcgcatcagaataagcaaaatgaagtctttaatcagttaacattttacacattttataatttcatttggtatcctaataataggccaatacactcaacaggtggaagtgcttgagggccattgggcattgaattttcctaaagtagcgcaattaaagaaacacctgtgttaaataaccaagtgctaatttactatgaaaatatgcgaagtgtttaacagtgctccaaaattgtgatttgcttttgatcgaatttgtggatttacaatgagtaaatgacagtttattgtcaggcaaacgattacactttataaattagttaaaactatccatatcctcattaaatacatatggaaacagagatgtatgcagagtgaggtctcttcaaagaagctctgtttgctctctcataaggtaaataaaaaagagagcaaacaaaagtttgccctctcttgtccatctcattagaggttttggttttaatttttaagactggattttgtaactctacctaaaaagttgcacgaaatggctaaaacttcttctagagagataataatgtatcttttatgtggataaaacaaaaaactaggaatgcaatcacagtagtcagtaacgtataatacacacttagaggaaggacggaggaatcaatagtttctagaagagaaaagacaaaatggatgaggaaagaaaaaatattttcatgctcttcaaaggacattacaaaactgcaaacaaaaactgaaataatgtggtggtagactctgactattggaagtaatgttgattcatcataatattgaattgtctaaagtaagagatagacaaaagtagattttaacatcttttggacaaagacacagctgtttttataagtaaaaatgccacaatggattaagggaggctgaaaaaatctgcaaaataatgtattttggactctaccctaagactttctctgtattttggcctataattattctcagaaacacattttgcctttcttatatatgaactcaaccaacgaaatagaactctaatgcacttttaagaggataaacacaaacggtaaacaaatcattaaataagttactgaaatattagatccctcttgtcccccagcagtgtttttctcccttagtctaccttcagttgtagggcaaggaaaacaaaagacccactttggttttagctgaactgtaaaatatacaggattaattttccaccgagccagtgtatattttgtctgtgctataagagaggagaaaacttgatcaataaagtatatataggtttggaaacactttttgcatgtaagatatctcccaaaatacacagtgttttatacacacacacacgcacacacacacatacacgtgcatgtgcacacattctttgggtagatgacttttacatccattgtttagacaagaaaggtagcaaggttggaaaagcctggtaacaataaaaatgctaggaagatgaagattaagtaccaccagttttgcaaaaggtaacttgtaccatttatatcctgaggaagtgattttgtatgagagagttggaagggaatattgtgaagacacagcaagtacggagttatgatagggtataatgttccagaagggcctgtggagagtggggatgaggtgaggagtcaggagggtaggagagtatatcagtgatactgattccacggtgatgttctataacaatctcaaaacctcattagcatacaacaagtgtttattgctcacatacctaagacagttttctaggggatgtattgatcttggttgggttctctcacatgtctgggatttggctggcttttcagtcatctaaggtgacttggactggcatgactagggcaacttgtggcatgtgtgttctacacatctctcatcattctgcaggttatcccaggtatgttcttatggcaatggaagagaaaaaaaagagagaagacatgcccaatcatccaaccattttcaagactcttttcatttcttttgcaaacatcccaaaggacgtcatgtggtgaaaccaagagtcagagtataataccctgaaaaataatatggcaaaagggcatagataaaaggagagataagactatttttgtaacctaccataaggttcctggggagaagagacaactctatcctcaactttgtagcccaaaggtaaaacaaaaacaatctaacatctatagtgataaaacttcaacaggcttagagattttgttcctttttcattttttttttctcatcaaattgtgctagattatgctgcagtaactgcaaaacctcaaaatcttagctgcaggtagggtcatgcccagagtagtaacctagggatctgcgctaatgggagctgtgtctcaagccctgcttaaactgctgctgaagatgcaggaaatacgaaaaaggcaaagtgaacaccagttattaagtttttatctatgaagtaacacatgtcctttctgctcatattttgttggtcaaagtaagtcacgtagcctcaacaaaacacaaaggggtaaggatgtacaatcaagtcctaccatgtagcagaaggaagagaaacagtatttgtgaacgatcctaaagactgtagagttttgcactggggagtagttcttaaagagaccatcagtatatccccacctaagaaagaagcaaacagcacttcagttgaattattttgtttataagcaactttgaggaatagtatttatttttatagtgagaaatgcctaacatattgagaaatatctggaaaaaaattatcaagttcattattataattgcctttttgaaagaataggtaggtcagccaacccacagtggaaatacttaaacaattttcagaggcaagactattaaaagcaaagttctaattagctaatttggcaccaaacaacttccttttggcctacaaaattttcaaacattatttgattgagttcagaatacctgggattaaaattgatatttctagttcaatgtcctcatataacaaacactatgctgtgatcttgtgaagaacaaaaaataatataggcacactgagaaactggagaaaaaaataatctgaaagccagatttctatattaggaagtctttcaaattattggctgaagtagttattgttattttaaacaggctgctgttgccatcaaatctaatgctctacttcttattctccccataaaaataatattttgtgaagtttttttttctgaaaaacaaggcaaaataaagtattacattttgaaagtatctgcatgataaacagaaaagtgaaaccaaaggaatatgtgctccccttcttacattattataactgtagaatctgtgattagctggagactatcatggggtgtactgtgtgtacatgtttgtgtttcttaaaagaaggtgatgccctgcagctcacagataacacaaatagcatatgatgcagtagttgctaagggcaaccacacgtattttctgtcatttctttatccctaaatggctgaacttaatgatgttcccaataccaaaaaatctgtggatctgtccttagaagtttgacaggatacagtctataatgattattggttgtgtgtgtattggggagggggtgtgaggcatttcaaaagagtggacctaaaattcactgctttatgctgagaaaaaaagtatgtacactatattaaaatctgactcaatatcaaatagacccaaaacatgaatattgaataatccaagaagattgatttagcatgtgatattgctaccttttatgttcaaatttccataatgtggttgggccaatagtagaaaatgaattttatgcattcttttgaaaaattctaaagatcaaaaaattattctggttgatgataaccagagaaatactcggcaacaaatatcatcagctgagggaataacgtatttgtatccacttttgtttgaatttaatagaaagctatataatggaattcaacagcaatctcttctaaaatagaaaaggagattaagagaaaaacatataactcatatttgcaaggaagaatctgtttcataggaaacagcatatatagtaaagttctaattagctaatttggcacatttgatcacattaagactaagcacaaatgcttactaaatgtgaatattcaattccacccaccaagattttcaagtttttgtgttgtcctttgttttggaaatgatgttgctattgttgctttcctcaacttctgccacaggggtccataataaaaagtgaatgggttcaaagagaaacaatggctaaagggtctcctgtcacttaggcagaattattattgtctctgcagctattgcccttcagagttctaacacagcaccaaatccttggtaatacaagggcttgaatgaagaatagaaaatgtgtccacagagttagtttttacttgcattgaatctatagttgactatttacattcaaaaatatatatttatttctacaaaaaaagtgttactagaaaaatgtggagcttcaatattcaaacctaagtatgtttccaggtctcagaatattgtaataaaaagttagtgtctaagcacattttttctagtcaaccataaagttataaatgacccttgtaggccttaggatatattgattctcgtgttgcattaataatttgctaattgacacactagtgtgcatttagttataaaagggtacgtgtgtgcgtcaatgtgtgtgtgtgtgtgtgtgtatgtgcgtgaaattgctgagttagatctgagcacaggagagcagctttcttcccatgtttggtctgccctgaacatgaaaatttctggcattactgctaaggatcatgaaagcgagaaagggaatgaatcagccctttatgtaaaatggtctttcaatgtgtggaaagtgatgtcaactcagggaatgttgttttatgagaaacaaaagaaaagtagaaataaaggatgagaatagaaagacaaaatttcttgattattttaagcttctgttttgaaaaatttatcattttccaaattcttagccagttcttaccaatcagtagccactattagccaaagcgtaacttctgagatagatagaatgtaatccatcaaaagcaatgaatccaaaaacacatgagcacgagcgtacatgagtgtgtgtgagatatgtgtcagtttccagataaacacttatcagtgccctacaatccatacaggtgaaaatagaagtttgaatggtagaaattaccataccctggtggtgctaccttgggaagcttgctgcaggaggtaaataaatctccagtagaattttgaagcaagggaaaagtttgatttggcagagaagtagaggctgaagaggttataatggtaggagaatagcatattctgcacactgcagaaaggggatagttatgcttggcaatagcacagcggactaagcagagtgcagtgggagaggatggtgaaagggttcaaaaaatacaatgtctaaaaggcctcctgtcactttggcaaaattattattgcctctgcagccgtcatgtcttctggtggcaaaggaacccttgtaggacaaaaaagtttctaaaatgcactgactcttggaggccattagtatatattgattcttgtgttgcatcagtaacttgctaagtgacacaccagtgcgtatttagtgaactgcagcaatgctttgccaaatgaaatcctaatggccatgacagagttaatgtacccctgaaccttttggtatattcttcagaagaaccttgcccacagagaaaatttgcaaaacacggctctctaataggattgatttttttttgtagttcagcctattcagaacatttaggggaggaggctaatgtctgtccaactaggcttataagagaggacagtcttttttttttttttgaggctgagtctcgctctgtcacccaggctggagtacagtggcatgatctctgctcactgcaacctccgcctcctgggttcaagtgattctcctgcctcagcctcccaagtagctgggattacaggcgcctgccaccatgcctagctaatttttgtatttttagtaaagacggggtttcaccatgttggtcaggctggtcttgaactcctgacctcaggtgatccacctgcctcggcctcccaaagtgctgggattacaggtgtgagccacagcagctggccttttttaaaaaatttggcttacaatgtttgtttgcttgtttgtttgaccaaacattctatgccccttttctatctgtttgcttgcttataccctagcttattccaaaaagggtttaaggtagttttgcttaatttgctatttaatgtgtctgatttatattagcattgctacctctgtagaactaagatcccaccagactcttctaggatcactagagtttgattgtatgtgaagcattccatctcctcctcagtcctccttttctggggcctattctcacttcatttagaaaggaaacaggcacctcattgttgtagtacctcagcctgattataccatatatgaaataatcacagtgctaatcaggctggttctgctggtctcactccttgactgcaaatctcagcagcacacagcagggcctgacaacttccatactgacaactcctcccagaaaaaaatgcttaccaattaaccttcagtcacagtggatcgaagactgacattcattattttaatgaaaatagtaagaaagaacactattgaaacacccgaagactaactcattattctgttggatgttcggcttagcaaagtacaaaaagcaagctcagggtcagaaagacaggacgctgggtgtaaaggagaaataaagaacaggtgccccctgcttctcatgaaccatctcctaaagcttttgtaaccattttccagaggagaagagaatagaagttgcttgtacctcaggagggaactatttcaagatgactgaagtataactgcacataaaatgttaccatggctttcttcttaacttttctgttcccgtggccagtgatatgtttcttctagaggctttgctttgttgttattctgcatctacactttaaactcaaactttttggagcaaaagttactttatctattgatgtatttgacagagttaataaataatcttcctttttttcaggagtattgttgaaataacataaaatgtcctcttcgttcatgcttaagaaatcaaaaatatgtattgaaccattcaccttacacttattgagtgtctactatatgccagaaacctcactacatacaatggatctaatcatgtataagatagaggtctctgcttttgggaaactcactgtttaaaatcttggggtgggacgggggatgtgtttggtaacatggcctttccttgcaggcactttatttgaaatacttcatacaggcaagcccaggcctgaggaaggcctgtgatactgttcagacttttcagctctacttcaaagcccacttacgcagggatgccagtcggatccactgcttttttgaatcatggaaattagcttacaattgaaatctaaatcattaaaaaagaaagtagaaaaagactatgagattggggcaggagggcattcaaaagctcatggtaaatccaaacaatagacccctgctagagtttaaatgtcttattttgttctcttaatttttcctgcatcatttcaggatattttttcttttcaattaaacataagcatacagactaattcgcaagagcctaaaagaaatgtgctctggaaccatctggctcagtctaaccttttcaaacattgagcattatctcttttgtgtacacagaactagaggaactttcttcgggtacagccccagagtcttccctggaggccagcccagactcaatttttgttgaatagctgagctgtgatcagtggtctatatatgtgatttgtgtctatacttccttacacatttctagagacacaagtcatcctggaagcagtatatcatctctttgtttcggtattgtagacagtgccagtctggctattaggtgttataaagaggagtaaccatgttcatttccaaggtaggggagcgcagagggatttccctgcctttctttccttgcttctgtaagccttgatcagatttgcttttatataaatctgttctccaatccacttgaacagaaaatcaagcaggatacactttcagacctatcacatctcctacctaggatttctagcatatatgtaatatacatatattagaaatatttagaatttggagatcactcagtctctcttaaaccaaatggcatttgatctcaaagccaacattttcaacagaagggatttgaagtgattcatttatgcataacatacaaggtcagaacatgaatttatactcaggttagggtttgtctcagtaattacagattactgtaattactcccaacaggacttaaaataaaaaacagttgcagtgtagtggttaagagaacaaatattaaagatgggctgttggcttcaaatcattatccctacacatgctagctgtggctttgagtaagttgcctaaactctctttgcttcagtttgtatatttgtaaattagagtcattatttgtcttctaccattacaacacagctcacagggaatcttgtcttatttgctgtttctcaaatgcactgtgcctgttaacagggcagatgcttaagatttcttgaatgaagagagcctaactaccgaacttgggttacatgaggattaaataaatgtacatacagaaagtggtagtgcctgttatgctgtaaaccaccaaaacatggcaagtgactattattatcattattataccctcaaacttgaataggaatgagcaggcttccccacctgctaaatttggaagctccatcataagctttctcaaacaaacatgtgttctgattgaaatatgttacttattgaggatacattatgtgtcagacatggtgctagatgctttgtggtatttcatataatccttttagtaacagttggagagacctgttatctttatcttacagaagacaatatagaagtggtctgcatttgcagcaaacgttgtggggaatgcagaaatttgtgagatgcatattgtttgcccttaaaaacatgagatagttacaataattaccttttggggctgttgtaaggtttgaatgagaaagtaaactccatctactatgtaccataccagggacatagtaaatgctcaataaatcttaacaataaggatgaggatgatgtcaatgatgactgattgtgaagatcatgatgttggcatgatgtaagggaggaataacaatgaaaagatgggatgagaacagagcatctttcttgagagcctagggactctggcctgaagcaaggaatcaactgacttgccatttgatttccctttcctgtggggcagttatagtatttctattaggagagatatccaaaatccatgtaatcaatgctagatataacaggaagaggaaatgcttatgctcttgacctgcataatgactatgggacacgttttaccctctttcaattgaaggtcaaaattgaacttttaaaaaattcttaatttttttttccaatctattagtttacatattatgactaattttttttcttgctcagttttaacaaggtggggatttgggaatagagttaattacaaagaaatacacatttatcaccatattgtaacactctaggtagcgcttaaatttttttaaattaatatatgacactttgtctttccagacaaaagagaaggttcaaggtttagaggaaagggaatcgagcttgaagttgcaagagttccttaaatagaaaatgacccaatgaaattgggtaagttagtcagcatttagagctttaatttcctaacttttcaaaatgtagtttataatcaaaatactgcatatttgtgtgcagtgtagccatacttgtgctcttcttttgttctttacgatgaccctgaaaggagttgggcaggcattattatactagcttaacaatgaggaaactgagtttcagaaaggttaaataaatgtccaaggtcacatacacagctagtaaaggttacatccagagctcaaaaccttgttttctatttcacatacaatgttttctttacattacacacacaagtgctccaggaagaaacgtgatgagtggaaaaggctgtctcaccaagaagctgtgtaatattgcacaagttacattccttctctgtgccttcttttctttactcataaagtgagagacataattaatttttgcaaagtctccacagagcatgctttatcatcattttcataaataagggaacctaagcagataaaagtaacctgctttgcttaacatcacatagaaagcaatagagagaggctgcttccatctccagaatgatgtaacttttgcctagcaaggggtaattatctacatagttcaaaagaggaaagaaagaaatgaatatatttttacatgctaggatgcatagtgaagtctacttccatggtataataacaggtaaagaggagaaatttcctactgccccaaaattcacaaaaatctctatctttggaagtctactaagtgatgacaagggtgacagattactccaattatgctaccaagcattggttcttgccaacattttcctaagagccatattcaagtatctgaaaagggggaacttgtagataattttgttgattttcgtggactgtgtactttattcctacacttaggattagcgatgatgttgctaataatggagatgattgctaatgaataatccatgcatgctgttgaattggcaaccacaaggcaaactttttaaattttatctttaattagcttttcctctgaacacatactgtgcattctctatgcctagaaaaccactcccctgatgacatttgcacccaatctttccctagttaattcccttcatccttcctgtctcagttcaataatgactctcctccagaaaacctttcctaaggtttatgctagttctcctcttaagtagaaatccgttgtttttaccaacacaacaatgattctgcttcagagaaatatggcttggttttctttgaaagaacttttcccccacgcatgtagtgttgagagggctatcaatcaaggccactcttctttcctaaccaagtaatggaaatttgacctgcactaggccactctgactctccctcacaggaatttgtaccttgtgcagcattgcaaagatggaaaatcgagccaattcatctgacaaccctgtccattaatccgtgctccctggatgcctgaagctgctctactacttgtttctcagactcctggtttatcagctattccttctttacagccttacatactttgaatttttacttatgttaatccaaataacctaatcatacatccctgttacacttatttcattttgtaagtgtatattttggctgattatttggttaatgttggtcaccatcactgggctgtgagctcctggagagcaaaattatatcctcaattcttagaatagtatttagcactttccagtaacttaatacaattttattttatttagtggatgaacgaatggaatttcaggttctgattgctctctactctttcttaggatggggattctccgccagcacatgccatcaatacttccttttctaaagtctcatattttgggccttttttttttttttcaatctcttgctttccctcctcttcttgccatctccctgtcccctccccttctctttcttcccagtctccaattatgctgatgtcttcaggactgggtttctcccttgtcataaaactctactttgaccatcttttactttcaggaaaaatttccaaggtctttcatgatcttaagcctgattgcttctgttgtcacatatcctgccttagccacacttgtcttttcgatctgggcaggcagaactcttacagttcttggatgcaccaaactcccttatatccttgcccttttgaaataacaactgtcagctcttcctgcagtgacttttatcttcctctgttcctcagttctcagccctaaagtttcttcctccatgaagcttccccccaccacaacgtccacctttgcctaatcttggactagtttggataacctgcctttgtgttcctaaagctccttctctaccactttattcttacatttgttatttattttatttttaaatttttctgttgttttaccctctccttttaaactgagcctcttaagggcagagacctaaaatttttccctgtatctcctcagagcccagcatgatacctggaatacagcaagtgttctgcaaatgttaaaaaaaaaaattaataaataaaagattgactcatcctcctagctgaactcttttcaccgcagttttagtgtcacacttgtaatcctcttatagtttttattgatttcaacttttcgttatagatatctgtatacatgtcttatttctatggtttttataccttaaaagtagagcctacttctttatctataaatgtattctgcagcatctggcatacttcctggcctataatgggtgcacaacaattacctgttgaaaaaaaatgaataatgaatcaagccatactagtgatatggtatattaaaatgtatagatgaaatagtcacatttcataaatagtttttaagatgacagtgacttatttctaaaggaatgaatcccaaacatggagtttcagatcggttaagacagaaatgagaggatggaaagcctttcatgatacttctcaaattttattacattagcaactataatttcaccctaaataagtccagccagccttaaaattagatagttaactgaaatattaggctatttagtagtatgcagactacaggatctacagtatgacatcagatacttcttagaataatacaatactactgattcaatatatatatttcaatgacactctggatgaaaacaaaaagtcttttttttatcagaacacataggtgtaaatccctagttttctttaaatgacagagggatgaggaagacaagtacaagactgcacaggcacatttatgctactctaccatgaatagctaaatctttgtggtggcctcatgtttggtttgttagaagatgaggtttgttagtataatgtcagatcagagagagagagagaggtttagtaatgcacaatgcatttctttgtagagtttttgatggtgagattctttcctaattcaacttgaataagcaaaactttctagaaggtataagattaaaatgagagataaagaaagagaaggtggtaacttggacttggaccttgtttttaaacagtattaaaataatacaatcacaggcatgctagcaaagcaagaccaagtttaatgggaattgagtttaaatacctagttgcaattcccctttataccaaaaggccagcagttcacatcccaaattcagataatcactttttgcacaatgttactagtggctgtgatttgatatgggatgaaacagaaatagatcttgaataaactttttaggttcaggatggtgcacataccatcatcaatgattccagatgtttcaatatatctgttttgcttgaatacactccccaaagtgtgaatcttctgaatttactcctcaaatgcttgtcaatcttgttaatctcacacacctcacctagaaagtggcttatcaaaactaaccccagagattctccatcagttcttctttctcttctttctctgtctccctgtctgtgtctatgctctttttctctctccctcatttttaatactttgggaggaacataaactttatgctaatagaaagagcctgtactgagaatcaggggaattggaatctacctccaaaactgcagatatgtaatgtatatgaatttttcaaagaatcatagatatcctgcaggaaagatatttagtccaacatctctcacatttatttgataacgtagcctttttccctcaaaaccactattggacatcatgaaaaacaactgcagagacattgattataatattctaaaaatcactgcatgtaaaaagtgtttgaaaatgtttgtgatatttaatcttggaaaagaagagacttgggaagttgtatgtgtgtgtgtgtgtgtgtctatgtattaatacataatacatatatatgtacagtatatttttttaattaagagatttcaatttactgtgtgccattgtacaacataccgaaaacagccaagaagatgttgtaggatatctgttttggtcaatttgtcacagaggttagattatatctaaaatatcttccaactctaaaactggatgattttgtaaataattagcatatggttttttctttgaattttcatatttcattttaatctcagatgtgttcctacatggagacaaagaagagacttccatcatgatctaattcaaggggtagaattactgccttaaccccgacccctatcattaaaaatacttttccttccatcttgccacttagcctcaaatagtagtaggtctcacagtgatatatgaggatggagttttggagatagaaagacccaattctgaatcttggctttggttcttcctatctttgctatttcagacaacttacttaggctctttgaaactcaatttactcatctataaactgtggattataaggattagagttaatacatctaaagcagccactatattgttaaccttcagtaggtgcaaaatggaagatggttattgctatttctttctgttaagttactgttttcttcataagttatctgttaaaattcaaatagtcttgagagcaacacgtttgatcattatcaaccattattactgcagtccaagtaaatgagtcagatatttgagcacaggagagatatgttttgctcagtggaatggtggaggtaggacagagaagcctgagaagcaagggaagttactgaaagatcaggtagggaccactgaaaataaatatttcttggggccatctctgatcaacctctttgaattctggagagctaagaaaaatagaggctaaaaaataattcacaactgggaaaacacagatacttacctctgatcccttgtttagccctgctcctgggactaaacaatggaccagaaagagaaatagcaatggaaaacaaccatcatttcagtaacacagtaaaattttttttcaaaaaagatattaatccctatattataatttatgcttaaatacctaaaatgaattatatactattctctagtcaaaatgaatttaatagctttctagttaactggtaattccaccctctcccccaggggcagaaaacatgtcactatgtttaacctttttaatgtttttaaccctctcgctatctttaaagagagataagctttcattttacatttttaaatgctatgtatctggtttacacaccataatacaactctctatgcaccaaaactgctttgacaaatggaaatttgaatggtaagggccttttagcaaaaatccacattttagaaataattccctacaagcattgtacattttctaaataagatatgtgccaccacaggcaaggttagattgcccttatcttatggagctcagcagagtttccattttttgaatagcatcagataagcagtctgtaaaggctctacaacacttcattcagtggcagtatttccacaaatgtgtagctacatgcagggcacgacaggttggaaaaattgaaattgcattaaaaaaatctgccacagaatttctatattcgttgtaactgatatcaccacctggagggttcaaataggtaataaacctatttgagcaaaggcatagcaaatacttctgtaaggagaaaagagctctgtgagggagcccacaaggcttcaggcaattctcatgtagcaaaatcccacttaaaacaaacctcccctttctcttgggatctcctataatcctggaattagatggatcagtactggctgtggttgctctttgctcagagaatttgctcaggttgtatggggctcattctgttttccctcaaatttcaaaattgagtgttgagaacattttacttattaatgaatttctcaaggtggtctttgatccatgattctactttgtattctccaggggcaaattttaacctcgaaagccttaatttcatcagtttggaatgaacaatgtaaattttgcctctagtgtctctcatctatcagactgtgagcttttctgggacatggatatggcctatttttccttcatatccctcctctctagcatagtgcccaatatcataaaggttgaataaatatttgtagaatgaatgaatgaaggaaggaatgaatgaatggcataaagtactaaggaatatggctagcatgtaagagctcacctgcctgtttactgctgtatggaattagcttatgcagggtaatctacacaaatgatcacttataaacttttgggaaaaacttacatgttgattttagtctatacaaacaaagatatccctttagtttttccaaatgtctcctctctttcaaaattcttttgtgaaaacgatggggcaaatgaaaacactcttgtcttcctgtgattaaaattttaaagaaaaagcatggtattttcccaaaaggattcttgactttgaaatctccttgctccacttactgctaaaactttggtttattgacctgttacaaggtctatcaatgttaattttacttacactgggtaaacaggaagtattttcatttgttaaatggttgtctaatgtgtctgtatcatataaagaagtacaaactattttaatgggaatttctcaaatacatgagctataaatatagtacattaagcagatataaatacaatgcatttttcataaattcaaaagatttgagagtcaggaagatttaaattataaatgcaattttttgtcttccatcttaaaacctccaagaaacctacaacatttaactcttatcctattcctttaagatggaggaggaggaagatattaaaaagagtctctgttctgccttctaagatcattactttattttccagaagtgtatcctattccggtaagacagatatgtcccattgatcttagaaatatgttgttccatggctgcaatttctttctctgaaatcatcctctggcattttaaatttattaccaattggctggtgcagtgtggttttcagttgctgaaaatttagagtccattacaaaagtgaggtttggagtaatttcctgttgtatgtttggtgccaaagttgccacaaactgatttttttatcactcttttggctgctgatcccaatgggaaaatcagtacttttatttgcacagatctgatacaaagaatgctatctatagacatcctttgtcaaagttgtaatcatctgtttcgtaagagagaaatttgagacagaaacattaaaatgcacctgaaaaaatcaacagtggaaatctgagttcattctgtttgatggcttcctctgctcctagaccttaaggcaaggtcactgttgctgttgtcatgggaatctgggtcatggggaacaaaactcaaacccattttttaacaggataagaaaaagaattttcccctgaagcaaattattcatttttcttaaacactcacaaccataggactagttagtggtctagtcccaaaggggaaatgatttttaacagatgaaagctcagaagacatctccttcaccaagaaaaagcaaagcaactcatgatctattaagtaaaaggttaatttttattagtgacaaagttacttatgaaagctacaataaacctgtacaacaacagtgtcttcctcttggtttttcaactagcattttaattataacagggtaatggcaccaggtgtttcagagattggtggaatcagattgagtctgactgtccactaaaaaccatgctctctgaaagtaaaaggaacaatcctttacctcaccatgctcttctagggatggacctatgcccaaattgcttttcaaagtgtttgggcatgtaatgaactccagtaccatttggtaagtttgatgatgtcctcagtttgcacatacggttttaacaccccttttctcttttcaacgaaagtactgtaacagttttccgtgcactaaattggatactaaaataaatcaggtcttatatctatgaaaatatgtgtacatgcttacatttcttatattctgtatttcattatacaaaaacatctgaaaaaatcaatttcttcttcacctgcccatcaagagtcagattaaggatttataagaattgatgacagcgcttgcaaagcatgcagcactccctgactgctcctttcccttcagttctttcagagcagagctagaatactgattgagaatttcttctgttctgtgaaggaaatttacttttaaatgttctcctttaaaatgtgaatgtgattatcattatacaaatgtatgtggcattactggcatatttaagtttcagcacataatgcacactcctgatttagaaacttaaatagtttattttttaagagctttccatttcacctttaagcttgtgttacataagcttaatggactcactcagctccgtgatggggagaatccaccaggtgaatggcagtaagctcatgagctttgaagggcttattttgccagattgcaactccaacttactgtttggagtagcactagtctgcatgcactgattacaacaccgcaaagctctgataatatttatttcagaatgaaaatgtcttttgcctccatcctcctcctttctttttgcataaatacagtaagttaagctttaactaaggtgatgcttgaattaaactgacaaatccaactgcctgaaatttaggattgcatttatggatttcatctacagtatatcagcatcaaaatgtcagagacagtgagtcacagccaggagaagtttttatgagttttggaactttcagttcatgtcattgttgtgttatctggcactggtcagagcagcaggactgatgaggatggtgagacttaaatttagtacttaaatattccttcaaagtagagatttactctggcatatgggaggaataaagcatatctttaagaggagtgtgtgtatgtgtgtgtgtgtgtgcttttcaaagaaaaagtaaaacgctagtgagacagattgaaccagaatccattttagcaaaatgatacaatagtccttgctttgaggactcaaatgacaaagccttcagttaatattaggagaaatattaatgagatatcttctgagaagatattcttgagaatacaagttctgctaattaattatgcatcatttttcaaaatagtatttaaattttttttcatgatgaaggatcacacttggtttatgaaataaatagcaaacaactatttagaaagcaactctagatttgagactctgccatcttctgctagagtcagattcatggcagcctttcaatgaaggcctctgtaaagtcatcctgtggaggaggctgagctctctactgcagccttacttgagtgagaataccactgtgggtacaacctaacagtacaaaataactactgtcaatatcacgttagagtcctggggaaatatttcacctcttcttcttagaaccatgaaaactatactggaaattaaatggacaaacctcagatgagtaattctgagagatgggggtggtcttggcatttccttcccagaatggtgctgaagagtaatcagcattccattgaaacattctgttccattccttggccccacagcttcccaatcttacttcctttttcttttcctctcctcttcttctccccagccaaaaaaagaaactggaaatgtttgggtagggaaacactaaattgtagataatggtgataggggaaattattcattttcattttcccaacttaaatgttcttgactcaccattaaggccataaaacaaaaccaagtagaacaaagcaaacccccactgccaagacgataatctcatttaattaagctcctatttcaaaaagaaaagtttactgtagaaatctctaaaaggggaagaaaatcttgcaaagacaagaaaacatgaatctgaacatatcatggggtggctgggaggagaggggagtggatggatacagaaaagagaaacttcaataagaggaggaaaaaagagagaaccaggaaaagagacagaggaaatgtaaggaagaccacagatgtcaaaggatatttatttctgttacttgaagagggataaattatactcttgcatcaaaaccctcagtgcttagtattatcacattcactaaacatagaaaataaattatgcacataagttttcaaaataaaaaaatgaagagagaccaaagttgacaatttgttagcaattaagtagcaatatataaccttgtgggcagagaataccactaggcctaaccttttaaaatgtagcattttgtctatttttggaaaaatataacacattcactttgtgtgttttattagtaagagttctccagagagacagacccaataggagatagatgaatagataggtagacagatagatatatgagaagatatttattagggaaattggttcacattattatggaagttgagaagtgccacaagaggccatctgcaagctagagaccctgggatgctggtaggatggctcagtccaagtctgaaagccttagaaccagagaaagaggtgtcttagtctgaggctgaaggccctttaagaatccaggaaaggtactggttaagtccaggaggctaaaggctggaaagtatggagttctgatgtcccaaggcagaagacaaagagcgtcccagctccagaagagaaagaagaactcaccttttctatgcctttttgttctgttgaggcctccatgcaatttgatggtgcccactcatgcagagggtcagttaattggcctattcataggccagtctcctctgcaaacactctcacagacacattcagaagtaatgctttatcagttttctaggtattccttagtccagtcatttaccattcatgtgtttaaacaatatgtatgtatttggtacagtgaaacacaagtgtctctgtgcattagaagaaaatgaaagcttgaaactattattcaaatgtgaaaacagtcctctagatattttctttaaagtacatggtacaaagcagcgtacagcccatcgtggactctagaatatgtagcgcttgctcaaatttgcaaaaggaatgaataggctatgtaaaagtacaggagattttcacatttctttcattctaagtaaataatccaaagcaattacaagacactttttaaaaaacttatattttcggtttggggatccatgtgaaggtttgttacataggtgaactcatacaacggattttttaatatacaaataagtaactagataacgttacattcatagacataactttagatcacaaggcacattgttttatgtgattatcacagtcaatctgtgaggtttgcagtacaagttatattttctctcttctaaagatgaagaaactgaagctcagagagttgaagtgacttgctcaggattaaagtataaaaaaatgcaactgaaactcaggtctcccaaatccaagtccaatactttttccatcaactacactgctactaaaactatgggaatcacaattaagtcagactgagtatggtcatctaaaaatcctagctaaagatttagaagagaatccagaagataccccaaatcccacccccaccccccaccccacctgaggtcactgtatttctctttcttttttttttttaactgagatggagtattactctatcaccaggctggagtgcagtggcacgatcttggcttactgcaacctcgtcttcctgggttcaagcgattttcctgcctcagcctcctgagtagctgggactaggggcacatgccaccatgcctggctaatttttgtattttttgtagacatggggtttcttcgtgttagccaggatgatctctatctcctgacctcatgatccacctgcctcaacgtcccaaaatgctgggattataggcgtgagccaccgcgcctggccggtcactgtatttcttagtgcgtcatataccagacatcttttcctgcatcattcacaactcctagcaatagtgtgtcctaggtatacaataggtgtccaataaatacttatttggttcaattactgctcaaaaggcttaaaattaataatcaatctaataagctgctagtgtttccatcaaccttttgaattgttgaagaaactctagaattaaggaacacatggtgttaaaactgcctatcagatatatcaattttattgacatgcttttttgcagagatgtactatagacttttttcttcttttaaattcagcaagcttctcatgcattcaaaaatataattacaaaatgctccaaatattatttcaaaacctattagctgctttttgaccacaaaatacaaacttattaaaattatgtttggaaataaatatttctgtgacaattgtaataaatgtgggggaaaaaaatacataggttaaaagcaagagtttatgtacatgcgtattcatttttctctaataaatgcataaaggtacactaaactcaaattcaggactattcattctctttttgtttctaaataggggcatgtataaatgtagtcatttttctggaaatgtggtaatagccaaattcaaaacatttaattggaaacatcaaacactcattttgaaggaagccaatctcaaaatgggacctagaagttcttatgtcatgccatgtttggatttacagctactggatttatggctattaaatgaaataaaagccaaaaagtttcaaaatagtatgtttgttagttgtggagaatccagtggaaattgtggcttttgaagtgttatagacagaggagagatgtcacaaaagtgtccacgtttagcatttctgctaaaatagacataaaacaaaacaaaaatatcctgtaaattaatgtagcaattctgagttgctgtttcaaagatgtggcaactccttgtcacttctctaggtactactgattttactgttagcattagaaaggaagagagctatatgtagtgttacgatttaatgccaatatttgtttctctatcttttgaatgggactagtagcttcatgaaggcaggcatgatagctaatttgctctcaattttatccccgatgcctagtgtagtgcatggcacatggcagacacttgataaatatttttaatgaatacacaatatcaagagggaatgagtttgaaactggaggaatgcctcacagacacccagaaatctcaaatatctgaaatagtgctgaaaggaaatgcctcttatagtaaagaaatagctttggtgaaacaagaaagaatggaaagagtaaagagcacacagctgatcccaccctcatactgattgctttgttcatcaagagagtaaatttcatgggttgttaatagtcaatcttctaaagtacaaaatctgaaaaatacagacgtcatgtggaaaggacagagaacaagaaaacaaagagaaacaaatggtagggactgagcagcggactctgacaccaaaggtcagaagcaataagataattgatttccttgtcacatgctctgtagtcttctgaatctaacagtcatttcattttcagtagttttcgagagacttataaacactaacagcaaaacagcagactttttggtaggagtagaaatgtctgtgtgtgtatttgctggtgtgtgtctgtggggtgtggacagccatctacctctcagtagtccttaggtacatccctgtaccacattttaaggatatcagctacaggacatttgttgtcaacctgaagagttacagtttcaatgaaaggacaaacaatggtatattattataggtctaagaaatagcagatgatgttcagaatgtcactgacaagtcaaaaaacccagcatatactagaagtaaagatttctggaaggtaaagccatgacctaggagaaggcttctttggattttgattcaccaattaatttcacagaaaggtagtcatgcacaccccacaagagatcaaactgctgcacactgttttcttgtagttttatgagaaagaggcaaacaaccaagactcagttcaatactagcaatttttcaagagaatgagttcctggcttcaatacttacataattttatttagcctttgaatatatatttataattacatatttgataataactctaaggaattaaaaagggattaaattatttcctatatgcagagtattttagaaatgttttcatttgggaaaaaaggcagtttaaacaaaagcactggttcttacagagtcatacgcaagttatttgaaaatctacttggctaagcctcagcattcctgcaagatgctacatagaccactttcagttgaataggaattaccaaatgttggattattttagccctgatgaagagtatatgcctattttagtttaccagtgtcacctgccgggtcacaaagtataaaacctgattcaacaaactgaagtatagggacccaatcacaaggtattggagacaagaactactgtacaagtgctgcaagatgtgaaacactaccattccagactcttacctaatgtattattgcaaatagttattacctcagaaacaagttcttttgagtagagctaatgctaccccagatacacctcaatatcctcttcattaaacagtcttaggaatactttaatttattgctgtgcttttaaatacaaattttctcataaaactgtaggcaatttccacatgccatttttatatgtggggattacttgagactgtttctaaccagaggaaaaattcatagtttatactaagatgaactcccttcattgctgcagtatttatagctcgtgaaattaacattctgaacaaatctctggcatagcatccaaataaatatagtaggaataaattttacagataaacatgtgcctagagtcagtggcaattgaaaacagaaagatattaaaacaggttacattgattctgtggtcttcctttatggttcagatggtgcagcctgtgaacttatgttacataggctgcaatgtttttttaaaaaaattatgaattctttattttgcatgcttttgtgttcacaacatatccaccaaataaaacaaattaagtagggatggatgacttctggtattcccacattctgaatttttttttttatttttatttgagagggagtctcactctgttgtgcaggctggagtgcagaggcagtgatctcggctcactgtgacctccgcctccgggtttcaagtgattctcccacctcagcctctcaggttcaagtgattctcctgcctcagcctcccacgtagctgggactacagttgcccgcactatacccgactaagttttttttgtatttttagtagagatgaggtttcgccatgttggccaggctggtctcgaactcctggcctcaaatgatccacccgcatcgtcctcccaaagtgttgggattacaggtgtaagccactgcgcctggccccacgttctgaattcagcttaattcctagtagtttaataaattcaaataaaccttatctggattattctcagaatccaatccttaaattttcaaaactgtccattaaaagtaataatgcggttttaatgtgttcattcatttaatacttgtgctatgctctatttggtctcaaggcctcaagtttaaagtctaatgttttaatcgttcactccttattgacacacttttggattcctttcctgatagtcttaagaaatatgtttcctttagctcaagctctcttctttttccttttaaataagttcagacatggaaagaaattggggatggataactaataaagtttccagataaattataagtaattcttacctcagatgcaatgttttctgtcagtggtcagaggccattatgacaaacatagtgttagtgacttttttgccaagacaagatgaaaggaacacctggaaccatgtttggtaaaagtgacttctgtatggttcatcaaaccaagcagacagaagcaggttcctaggagtgaggcaaaagaaaaacatggttggctgctttggatggctaggcaggtctagatagtttggaaacaaaggctgtttccagtccataaagtccatgagagcaagggtgaagtctgatttattaattgctatattcccaaaacctagcatcacatcagctgtggtctgaatgttggtgcctctctccaaattcatatgttgaaactttatccccaatgtaatggtattaagaggagaggccataggaggtgattaaatcatgagggtagagacctcattaattggattagtgcacttactaacaagcttgaagggaactgccttgcaccttccaccttccaccatgtgaggatgaaactacaaggcaccatctacggagcagagagccaggcctcaccagacacccaatctgccagcacttgatcatggacttcccagccttcagaactgtgagcaataagtttctattgtttataaattatccattgtgaagtagttccttaaagaagtccaaacagactaagaccgtatgttacaaagtagatgctaactaaatatatgttgactggccaatgtaatactaataagcaattcatcctctcttattagcacttctgaaaatcttattttcgaaagacaaatgaagactgcaagacagtctctttctctcaactaggacatttcaacataatatgaagacctacaatgtgtcaacaacatctggagcctctagatttgtaacatgtagacatttctcaaaatgtgagacacaattccaaatattttagaagtggtcaagtagattttctcgcacaagagaaaaaatatttttatccttcaggacggaaatcaaacacagtggatagaatgatgatatgaggtttaaatagtggcattaaataggaatttctatctgcaacatgcacagttgctgcggtttccatttgagttgaaaattaaggcaatgttgtagcttttctataatataaccacatgtgtttctacataataggaatttatattcatacactcaatacttctctgagactgttttcaatttaggcatttgtaaatgcaaaaagtcatttgatgcctaggtggagaaaggtcttttgttgaagaaaacattttactgattctaaaatgcagtttcttttcccctactaaaacaaatactggcaggctattggttaatttattaaaggaacatggacttcttctagaaagatacttcccattaagctattgagctgaataggataattctaagtagtttctaattcataattattcttgaatctgggcagaaaatgtcactgtcactatgtttgggatttgaaagaacaatccttgcagttagaaataatgaggaaaaacatgtatcttgtggggagaggaaggcatattaacaataaaataatgaaatgttaaacaaactaggtttaacatctaattgttcataatttttattttatttattcatttacttatttttactatttgttgcttaattccgtttgctgcaaatttatttggatttttgtacctatgtttatgagtgagattccctgtaatttgcatttcttgtacagcctttgcttacaatagttctaaaatctaagttggagaaattgcactcattttgaaactcgtggaagggtttgtacactataacgatctttgatgtttgggaaaaagttaaaatcatgttgctatttttatgattattgtgttcatatctgggagactaaataaacaaatagaccatttctttaatggtctattctgattttctgttttttttttttctgcaatcagcttcttattccaataatgtcaagagatttttctatttcattcaattttttaaatgtattaattgttcataaagttctttattatagtttctatgatcacccattttaatgctttttttcttgaccaatcttactatagtttgatatattttgctggtcttttcaaagagccagtttttggcttttttgattgcctttaatacaagtttatttccatttcagtaatttcagcccctataattattatttccctcctaacttcttagggcttattctgttgtttttaacttcttcaatgtttataacatgtgcattttaaaccacatattttcctgtagatgatggattggcttcatgtgacaaattttgttttgtagtattttcactgtcattcattgaaagtattttctaattttcatatatcttctttgacccaggaactttttagaattttattttaaattttctttacatagtttattgtttcggttattttctaatttcatcgtattttggctagagatcactatgtgattgatagttggttatttgttaagaccgtgtttgcagcctctttattggtcaatttttgtaaatatctcatatgtgcttaaaatgtatatgcactgaatgtgtgatacatggttctatttctatccatttgactaagcttggtaattgtgatcttcaatcttctatgtccttactgaaagagttcttttaaaacttcccatttcactatactagatattttgttgtaattatttcaatgatgacatcataaaatttgaagctatgttgttaagttctcagagattgagagttattttaccattctgccaaatttcttcattttagtattatgtaatacctcccttaatccataataatgctttgggataaagtatattttgtctgataaagatacagcggcactaggtattttttcattaatactttcctgagatgtgtttccttatccctctatacacttcctttttttgttcttaggtttgagagtgtcttattaaaatagcttatagctatattttgtcatttgaaattactctcagggtctttaactttttttctctttttttttttttgagacggagtctcgctttgtctcccaggctggagtgcagtggcgtgatctcagctcactgcaagctctgcctcctgggttcacgccattctcctgcctcagcttccggcccgccaccacacccgactaagtttttgtatttttagtagagacgggggtttcactgtgttaaccaggatggtctcgatctgctgacctcgtgatccgcccgcctcggcctcccaaagtgctgggattacaggtgtgagccaccacatccggcccagtctttaacttttaacatacaaatattacaacttattttgatgtttcccaaaatatttgagtttaatttctaccatattattttgtggctttgctttgcttttttcttctccttttcctcatcttactgtattgattgatttttctttattccttttttctcattcagtttggaagataatataatcttttctttgataggtatctctatgcatttttcagtttatttcacaaactaattttaatcacattttttattttgagataattgcagattcacatacacgtgtatgaaataacacagagaaaccagatgaaccccataccagttttctccaatggtaccaccttgcaaagttatagtacagtatcataaccagatattgacattggcacagtcaaaatacagaacagttctatcgccatgaggatcccttacattgtccttttatagctacattcacctcccttccatctcttttcccttcctgatccctggcaactactagtcttccatttccataattttgtcatttcaagtatgttatataaatgaatcatatagtatgtaacactttgggatcaacttttttcattcagtgtaattcccagagaattcatcgaagttgtatgtattgatgggtccttcatttttactgctgaataattgtctttatgctttaaaaatgcacactgatctgagacaatccaaacttaatcacttaatcaacaattccagtcctcttccaaactggaaaatggatcttaaagtactttatctcaaattccctcatctacagtgtttttgttatgaaatatttagtttcagtttgtttttaacccctaagttaattgcaattattatttctcttattctttttttttcggtctatgcttatacatatacttaccactttctgagctcattgttgcttcctgcatcccatccaattacttttggatacactttttttcaaaatatcatttcctatttcttttagtaactttctctataaggtatattctcatagtgtttgtccaaaaaatgtttcaattcacttttactcttcaataattggcaaggtagaaagctcaaggttagcagtcgtggtcccacattactttgaagatattattgcattgactgttggcttctattgttgctattaagaaatcctttatatataatcactatttttttttcctctggtttaaggttttcatttaacatcagtcttctgaagtttcagtatgacgtttacattcatttttacttatcctgctcaaacttattgtactttttaaatctaaggattcatgtcttttgtcatttctggaaaataaatctcaactattatgtcttcaaatattgcctcaaagcccatccctacatttgtaatgtctgggctaaaagtacaaattaaggctctaatgccataagtctacattttttagaaagttataaattagactcacttttcaataaaacaggttctatcaaataccttgacatgtatatctttataaagaaaaaaaaatcaggtgtacaaagctacagtttttatctgactgaaagttgacaaaatagcaaagataattaaattggatgactttgtatgtatatgggtgttccattgatgggccagcaatattgaaatttgtaaaaactaaagatgtgcataatgcatacattaatatctatttcttccatatagtttattttgcttgccttgtgtacatcttatataattctctttgaggacaggtggaacttgcgacttgcttctaacaaaagtagtgggatgtcactctcattattaggttaacttatataagaccccatctttacatactggagaaagagactcttctgctggcatcgaaaacataaactgccatgttgtaaggaaccctgtgagtgtgtcacatggcagtgaactcttggtggcctctagggtgtaaggtcagcctccagttgatagctagcaaaaagctggagccttcagtcatatagccacaaaaaaatgaactctgtcaacaacctgaatgaaagtggatctttccccagtggagactttcaatgagactctgttcctgtcaccttgactgtagcctcgctgtgagaccctgagcagagggcccagttaagccatgcctgcactcctgatccacagaatctgataatatattttatttttagccctaaaactgtggtaatatattttatagttatagataactaatacactaacaaaaatcactagcaatgttgttacactcaaaatagtcacacaactacttttctattgactctgttcatctaaatcagggattgacaattttttctgcaaagggataagtatttaaaagactttgcagtacgcagtctctgtcatgtaaatttgtcttttttttacaacctttaaaaaatgtcaaaactgttctgagttcattgactatacaaaaagaggaagtggcccgggggccatggtttgctgaacttctgttctaaaagatgaagcaaatataattggagtcattatccacaaaagtctatgtctttataaagatgcacatcaacataaatacaaaaaccaatagatgtatttttcatgtgttttcaaagacatatttttctctaaaatatttaaaattaactagtaaactgaaccacttatcagtaattacctatctaattatcagtaattccatttttttcaagaaaactttgctcacttttttttttttgagccctcaccaaaatctcctttaatatccatgtttctaccaagtcctttcaaggcactctaggttttctcccgtcattcacctcgaaactcttccaacctctacaaattacccaattccaaagccacttccatattttaggcatttgtgacagcagtactccatttcccagtatcaaaatctatagtagcctgttagagttgctataatgaagtaccatagactaactggcttaagcaacagaagtgtattgtatcataattctagaggctagaagtccaaaattaaggtgttagtagggttgattctttcagagggcagtgatggaagaatttcttctagccctctctccttggcttgtaaatggctgtcttctccctgtatctttttaccttgtcttctatgtgtgtctctgtgtccaattttcctctttttataaggacatcagtcatattggattaggcctcaccctaatgacctcatttaccttgattgcctctgtaaagactctatctccagataaggtcacattttgaggttctgtgggttagaacactgacatatgaattttagagggacacaattcaacccataactatatataaatatatatgcatatatagttaatttatatataattaactacattatatataaattataatttcttctgagtcatttgagtataaattatggacatcatgaccctatgcagctaaatatttcagcatgtatatcctaagaacaaggacattctcttaatcaataaaattatcaaactcagaaaattgatacaattatctaatattgtctatattcaaatttcccttatttttgtaattatgtattttatagccatttttaaattaaccaaaatccaatccagcataacatactgtattttgttatcatgcctctttagtgtcctttcatctgaatagtttttcagcctttctttgtcttttgtgatactgacctacttctaaattaggagtagtcctgctgttttatagaatgttggctattttgtagaatgtcttgcaatttgcatttggctgatagtacacacacacatatacatatttgactatatatatgtaattttaagattaacataaattttttaatatttcaaaatattgcaatgtgtatctgttgggaatatcacactaaattgtgagtgcttttggcacatgaattggaacagagagagaagcaagaaaaggaagctctttgcaaatgtaaactgacactttgttattcaagaatcgattgtaatcaagctgagaggaaggatttgacaagttaatcaatttggctttatattatctaagtaatttcactgctcataccctttccactctctgaagcagtatccaacttttcatagtggtacaacccacaaaccttcactgtgttcagatgtagttgatgtttgctttgaggacatagggcaagatatgtgaagaaacattctcctggggattaagtaatgtttttttatttcctttgtttttaatgagaatggatgattagggttactttttaaactttgctagtgccaagcaccagcacagaggcatctatatatttttaaaataaaatgcatatgtgtgtgtctgtaatatgtgaagaactctaaagtacagtgcccaggaaaggagtacctctggcctaggtgtaaggatagcaatgaacccctcatacaattttcacactccctctaattttctactcataccattccttttagacatatgtttacccttctcattccatcttcaaaatcattttaatttcttttatattttcatttttttctctattctttgtattctaggtaattttttaaaatctatctttaagttcactaattttcttttcatctgagtctaatcttccattttttatttcatttttatagatttaagggatacaagtgcagttttgttacatggatatactgcatagtggtgaagtctgggcttttagtttacccatcactggaataatgtacattgtacccaataagtagtttttcatccctcacccacttctcacagtcccacctattggagtctcctgtgtctattattccactctgtatgtccatgtgtactcattgtttagctcccacttgtaagtgagaacctgtggtttttgattttgtgagatgtttcagttaagataatggcctccagctccatctgcattgctgcaaaagacatgatttcattctttaaatgtgtgatttaatctagtcattaagttttaatttcaatgactttatttatttctagaaattcttggttttcctcccaatctgtttattattttctcttagcatcctcttcttttatgatgatttctagtacttctgctaactctgtatcatcttccatagacttatttaatactgtcatattttagccttaaccttttagtttaagattattcaatcatagtacattcctttatgttcaggtctttccttctgtttattttgttcttaattttttattcttgaatacacaggaaaaacacacttgaagcatatcttttattctaagtactaaagccagatttcctaagtttgaatcctggcttcactacttagtggctgagtgatcttgggcaggatacataactcatgctctctgtttgtgtgctttcccaatctatcgttcagttttctctggcacataggaattttcctttgtttcttaggagcacagattaaaatgttatttaaaactttgttttaaaggcatacagtaaaaatctccctcccaccagtatccctcagccatatagtttccctcccctgggacaacctctattaccagttattgagttttcttaaagagatggtctatacatatataaataagtaatgtcatcctttcttccccgccacaccattttgtatacaaattatactataaaatactaaaatacactatttgtaccatgctccccctccacacacatttaatatatcataaagctctctctatatcgatgtcatggcctcataataaaacagtgtatggatgcagtatcatttatttacctgttatttataacaggtaacgtagagacattttagtggtttcgaataggacttaattttattccatgtattgtagtatccacatatctgctcttacattgttgtaatttatgtctttcctcattttaagttacagaaagtaagtcaattcatgcaaatatcagtgcacatttactgaacacctactatgtgactgcactgtgagggatataaaaataaaattttatttatttatttttgagatggagtcttgttctctcaccctgggtggagtgcagctgagaggtgaagccagctggacttcctgggtcgagtgaggacttggagaacttttctgtctagctaaaggattgtaaatgcaccaatcagtactctgtgtaaatgcaccaatcagcactctgtaaaaatgcaccaatcagtgctctgtgactagctaaaggactttaaatgaaccaatcagcactctgtaaaaatgcaccaatcagtgctctgggtctagctaaaggattgtaaacacaccaatcagcactctaaaatggaccaatcagcaggatgtgggtggggacaaataagggaataaaagctggccgccccagccagcagcgggaacctgcttgggtccccttccacgctgtggaagctttgttctttcactcttcacgataaatcttgctgctgctcactctttgggtccatgccacctttaaaagctgtaacactgcaaaggtccgcagcttcattcttgaagtcagcgagaccaagaacccactggaaggaaccaactccggacacacagtggtgggatctcggcttactgcaacctctgcctcctgggtttgagcgattccccttcctcagcctcccaaatccctgggactacaggtgtgcaccaccacacccagctaatttttgtatttttggtagagatggggtttcgccatgttctgcaggctggccttgaactcctggactcaagtgatctacccgccttggcctcccaaagtgctgggattacaggcatgagccaccacactcagccgaaaaataaaattttaaaacataggttggtcttagcacttgtgtaacctagcttataattaagacaaaaagagtttaataatgacccagagagcatcctaggaagtgtcacaagtccgcacgataaaaaacaaaacgaacaaacaaaaaacctttgttttgttaccatttatctggtgttttcaggtgtttgtagtaggaaagcttccatgttagctcagtctatcaaggtgccagatctgctctgttgttctaaatccactgtctcactattgtcttctcaactcactgctgtctttaccatctgtatactaccctcataaaatcctgaaattgctctagcaagtcatctgtaaccacattattgctaaatccagtggattctgccctctatttacctataacaggatctggcaagtagtctgtactcagtaaatgagcgtgaagtgaattaatcttatttgacatcagagcatcttttgccacctctacccttcatacaatttttttatttccttgactctcttaacaaagttaatggaaaccagcagagtttcattttacttctctttactcctcctaaatcttctttcagatctcttttaaaatgtatccattaagtgttgttgcttcccaagcattcattctctcttcctggctaaacccatgtgctgtgggctttcagatgcttaactccagctcaggtttcttttctgatatccagactcatatgagacagccaggtgggagggagtcaatatctaaaactctactatgggatgtctaataagtaacttaaattcacacgacctaaatcaaacccataattccctgtcctgaatttgcttgcttccacattttctatcccatttccctgaggtagaattcttcatgtcatctttcactagtgcttttccctcaccctacccatcagctcaatctgatctccaaatcctgtgaactatatcttctaaagatctcttaagtctgtcttttcctttctatccctatgaccagggcttaattcaaacacttgtcatatcttacctatattatggcaatggcctcatcttcaacttcaggttttaactttactcccctacgctctaccttcaatccatcctccacttccctgcaagttcaatctttaaaattaaatctggtcatgacattactttaatttacagtccttcagtatctttataattgctttcaggatgaaatctacttagtgtgacattcaaggtccctgcttacttttttagcctcgtatctcaacacttccactttgcactctataatccagccatattgaactgcttagaattcctgaaatgagtatttgcacttaggtagcattcattgattcaatagcctggataagccgccattattatgcagcactcatcacaatgtttcatgatttcccataattagagacactatgtcatctctgtatcctcagtacttaattccatgtctagtgcatactaggacctcaataaatgtcaaatgaatgaatataaacctatgattttacatcttttcatttttcttctactatctacctattaatgtgttactagtaataataacacaaatatagaatacatgtgtctgtaaatatagatgtatatctatatataattacttgtttcaggccaggcactattataagtgttgcatatatggcaatgcatttaatcctcataacaaaccttgtatccctactttttttttttttttttgagatggagtctcactctgtcgcccaggctggagtgcagtggcgcgatctcggcccactgctcacctccgcctcccgggttcacaccattctcctgcctcagcctcccgagtagctgggactacaggcgcccgccagcacgcccggctaattttttatatttttagtagagacggggtttcaccatgttagccaggatggtctcaatctcctgatctcatgatccgcccgcctcagcctctcagagtgctgggattacaggcgtgagccaccgtgcccggccgtatccccactttttagaaattaaggcacagagagagattgtgtgactccttcagaatcacatagtcaataagtggtgaagttgggattaaaacccaggaagtctgtttgtgcagtccataacaggccataaggagagaaaaagaagagcatattttatggatgattcaaaatgcatcaccaagccctaaatttttgataaagatactctaacaatttagacttcatgtgacatatatagagcataaaactttagtataaaaattaaccttgattttgctgacctacattgttatcattgttattattcagttcttgatatttctttctcaggttgttttttgtttttgtttttttgagacagagtcttgctctgtttcttaggctggagtgcagtggcgtgaacttggctcactgcaacctctgccccaccggggttcaagcaattctagtgcctcagcctcccaaaaagctgaaattacaggtgtgcgctacaacgcctggctatttttttgtattttcaatacagatggggtttcaccatgttggccaggcaggtctccaactcctggtctcatgtgatccgcttgcctcagcctcccaacgtgctgggattacaggtatgagctgtggcgcccagcctctcaagctaatgttttattcgttggctacttctgatcttctctatgttcttcatcacatccattattttatatataaaccaggttaattagactgattggcttaaacaatagaaatttattttttacagtcctgaggctggaaagtccaagatcaagatgccagcaaggtaggtttcattctgaggcctcttctcttagcttgtaggcagctgccatttggccgtaggcttgcatggcctcttctctgtgcaggctcagatctctctctctctcatttcttcttctataaggggcattaatctcattatgagggctccaccttcatgacctcatctaaacctaattacctcccaaagacaccatctcctaatatgattacattggggattagggcttcaacatatgaattttggaaagcacacagtttggtccacagcaaacctgaagatgaaaatgaagtaaagaatagcaacattaacaaattgtgtaggtacctgatgtcctaaaataatttgtattttctaaaacaagtcatcttttaacagcagtattttccccatgccaaatactaagcaaagttttacatatatactttttgaacccagaattgttatttctgagaaatagttataagtatcaagtttatggtcaatgacaatgtctcttagaagtttctacagttacttgtaaatgtttcagtatttgggaattcaatggctatctcttgccccaattccttctttaaccagagttgcctgtagctcaaagcaactgaccagcaaaacttgtatcagcatctagaactgtactctacacttgaaaagtatgaacctgctgcagagtagaaagaccattgatttttcttttatagggcattactgtggcctccatttctgttataaacacatgactgaattttataaccagaacaaagttacaggccttacataatgataaatgactgattacaatacaattttactgtcatttgaaacactatttatatttttctctaaaacaaccttaaatatattgaatgaaactgagggtccttaaaaatatgaagaatgggctgggcacggtggctcatgcctgtaatcccagcactttgggaggccgaggcgggcggatcatgaggtcaaaagatcgagaccatcctggccaacatggtgaaaccccgtctctactaaaaatacaaaaaattagctgggcatggtggcgtgtgcctgtagtcccagctactcgggaggctgaagcaggagaattgcttgaacccaggaggtggaggttgcagtgagccgagatcacgccactgcactccagcctggcaacagagcaagactctgtctcaaaaaaaaaaaaaaaaaaaaaaaagaagaagaagaagaatgggggttgaatctgccctatgttttaaacccaaacaggctgctcaactaagtgggtataatcagttaaactctgaaaaactgatactctgtagacaccacaatatacttgtttattaaagtcccttgatatgaagatggctgcttgctgatctctgtttaatttcaaaaagtagttagattgctgctttttttttttatggcaatgaactgtaccataacacattctagtaagcaaatgctatgtattgctttgctttctagtcctgggcttatacagatgatgtgggaaaaaggactgatttttttaaatgcttttagcagttctgctagatgtgtcgttcataggattagagcttttttttttctttttcaaatttacctttttcctttcacaactgatgaagaggaagaggttaatggaatgctcagttctttccttgtgtttggtgtttgacattggtgtttgacaatcattgtatgtagtcttctttccatcaactttagaggaatttacatgctcctgtataaggaactcctatggctgaaactatattcgcttcaagacaacaaaaacattttcaactactcctgaaatctgaaacttctaactctgagggttctcatggacaaggacagcctttgtcatttctctgcagataccgcccaaagctttggcacttggcaagagcagctgcatgtatgtgcttattcagagaaaataaactggcttctctcacctaagcaaatgacctttttatttatagttgctctctggttttgattattttattaaaagtaaaacataaaaatttttctttatagttaaatctatttgagttgtcatcttcccagtgctctctaccttttcatgggaataaattgttttgctttctaatgtcaaacttttctgaatccattttttaagcactcttgctggaattctaaatatcttctgattctcaaatatgtgcataatttcccagcccatatccaaaatatgaaggaaaaatgtcattggacaagttctcacaataaataaaacatgcacatatttgttgaagagaaagaggtaatgaattttaaaaatgccatcaagtcttgaaggagtcatgttttacaaatataataaccaaatatttatcattttgttgttttgatttctttgttttcagggctttgaagtttagagtcagcctaaaaagttagaataagtctttgaaaattgttcccaaaatcaccccagggaaagtgttgagtcacagaagaacacaccatttcaccttttcgtgaatcaggataagtcattttgactgattcactgtctgaccactgggcaaagtataaatcatgtaagaaaatgtcagttgaaatgttagtgcactttaaggtcatctgttgaatttttagtgtgtgtctgtgtcatctttaaaaatcccaagcactaaaacaccgttgcaaagcaagtaatatttactcctcattacctctctttagaaatgtataagctgtatcatattcaaattcacatcagaacattcatgtgaattcacattcagtgtggcaaaaattaatgcatcgaacaaagaaatggaatttagtgctatgtttgttcatcggttggaaatcaatttagcaaaaacaaaactcctttcctactcccctccaaaacaaacaaatacaaaagtttgaacaaacaagaaactgcaaaaattttacagagtatcagaaaataaaagagaaatattgaaactaacagatataaaagtaatgtcagttacttaggaagtcacttttttcccccataggaatgacccagatgcttcattaatctacaagatttatcacgttttggcaacagttcagaacatagtttctaaacatttgccattttatcagtaaatatccatttcaacaatatgctatcagactatatttagctagtggtggttgtaatgtatgaaaggcaggctaacaacggagtctgaagtagtttttaaaaaatccttcaaaaccagctctacattctacaatattataaaataaatacaaaaatataaggcagaaattatgtggatagcaattaatatgcaaatgaagtagcaactcagcatgagaaaggaaaacagtggcaattattatagctaacattctggaaaactgagtatgtgttgttacctaacactttctaccacagaaaatttaaggagaaattataacaatttatcaagcatttgctgaactgctatatacaatatgctatgcatcattaaatgtcattaaaatatggcagttcaaaatatttgggcctttccaaaacccccaactttaaaaatacattaaggtaacaatacatacctgttacaaaatagttgactattattttgaagccatttaggtagaaaacctactcttgtaaaagtgagaaatgaactgctgctatccactgactatcactcccactcaaatgaaatctccataagtagagagactttgcggcactcaccactggatctcaaacatctggaagagtgcctggcacataatgagcacacaaccaatacgtgttgaatgaagacatatacatagagttgacaaccaaattaaatgaacaatggcaccttattacctacttctgaaacaaatcaatgtgaatggaaatactttgaatgatactgaaatggaactgaaaaaaaagcatcatggtttacaaacactttacaaagaactatatttccacacctgtatttataggatacttatgctgtatacataaaccactataaatatagttagctgtatgtattagtttgctagggctgccataacaaagtaccacagactagatgtcttaaatgacagaaatttatttcctcacagttctggaggctaggagtccaagatcaagatgtaggcagggttggtttctactaaagcttctctttttggcctgtagatggccatctctttgctgtgtctttgcagaatctttcttctgtgtgtatttttgtcctaatctcttcttacaaaggcaccagtcatatcggattagggacccccctaataatctcattttaacttaattacccctttatagacactaccttcaaatacaatcacatttggaggcacgggagattagggcttcaacatatgaattttgggaggacataattcagcccacaatactgtatgacacacaagatggagtatggttatatgaaaagtgaacaatatatacaaaatcttaaaatacaaacaatttaatgtgtgaattatctacttaattttcagtgaccacagagatgaatgaaacgataacagaagacaatatatgattacaaggtagcaatataaattatattcacaagtactgaaaaggataaattacattcacaaatgctgaagggattggaataaagacacattcaacatgggtatcaaggaagatttcctggagcaagactcttttgctgctgtttttttgtttttgaggcctatagtttcttaacaggggttccaaaggtatgaaaaagttaatatttctacaagaaatgatcaattgattccctcttaacaaagacagctgtattaaattatttactcccatggagtcatatttgcaaactcactgtagtatattatgatttaaggaattaggtgggtctattttggatctccagagtatttgtaacggaattatacacacggaaaaagcttcattatcaagttgtatgataatgatatgctagtatatgaggtgagtagataataaatatgaaaggaaaaaagataatatataataaaagaaaaattcaaactttcctgattttatatgcacagtctaactgaaaatattttgtttttattttctaatttgtgtcaaattagttgagggtgaagttgtagctcttaggtactaagctcaatcatgtcaataacagaaaaaagttttatatttacactaattgtcctataatattacataataaagtaacacctatttgttagatttccttgtgctttaagatagttttttatagaaaggatgaaagtgttccaaagatcttatgctgaccaaacatgaaggccagagagcgtttcctgaacaaaccaagaatgagttctgaaggtagagagtagtcagacagtaaaataaacaatatggcttatcttgattcacgaaaaggcgaaaaggcatatctacattactcaacaccttccataaagcaattttggaaacagctttcaaatatttctataatctgtttaggctgattatagaaattaggctgaaaattctaaaacaagaaatcacaaaacactgttgaatactgttgaattgttttccctataatatctactaaaaaaataatagaaatggtcaatggctgaatccttcttagtcttagcatgctcctgagcaaggagccaaccaaatgttagaaccttcttttctgaagtcaagatgtaaaatctcaataacaaattctgtcttaactcaagcagtgagtgtattgtgataagtgcttctcaaccccattcttccatgcattttctcaagtacaatatccttaaacaacaagggtttgaaatccattggtttacttagacgtgaatctttttcaataacaattacatgagtgtgcctgcctccccttccatctcctccaccacccctgagacagcaagaccaaccacttcccttcctcctcttcagcctattcaacatgaagaccaagaggatgaagacctttatgatgatccacttccactgaatttaattaagggtaaatgtattttctcttcctcatgttttttttcataacactttcttttctctggcttactttattgtaagaacacagtatataatacatataacctaaaaaatatgtgttagtcaagtgtttaggttatctgtaaagcttctggtcaacagtaggctattagtagttaagttttgggagatttaaaaattagatctttgtgcaggggtgggggctgttggagtccctaacacctgttaacatgtttaagggtcactgtcatgactttggggacaaaatcaatggccatgcttttgggattaatccatcaagaataatttaccttcacatttgaggcataaaaattttttttttcttcattggaagacctagaaacctttagaccttcaaaggtatgtcccttagactgaggagtgagaggggaattaggaatcttctgttttaggaatcaggttttaagtgtgtaatttgaaagaccaataatatgggctaaggtgaatgaggataaactgttcttattgcttgtaacagttaggtatgcatgttgagctctttaaggacctagatttaattcctaattatatacttaagggagtttagagccaaagtaattctgagtttaaacaaaagcaaactgctttggtggggcatgaaacccggcttgtcacaaaggcttacagaataaagatttcctgggaagtgacttaataggtactaatccttgattgaacctcagcccagtaaatcaagcatctcgtcactctttgactgctaaaccaagggcggtttaaaacaataactgaacaccaaaactatacaaaaataacattgattcattaaccaatttgttagttgagggggttgagacttcagtggaatagaacacaaaacacacagtaagatttaatggtgggaatgtaagagggatatgtcacataaaaggtctggagactttagagatgtttttgatttctctatttctctcacactctatgtctaactcatcaggaaatattgttggtctaccttcaaaatacatccataatctggccacttttcaccgcatccatagcgaccaccctggtccttgccaccaccatctgtaatagcctctcaactggtatttctgctttcctccttttttccctatagtctattttcaactaagactccagagtgatcttttaaaaatgaaaatcagaccacatcagtcttttgctcaaatccctgtgaaacatgttcatttcgaccaatgttaaagccaacatgcttacaatagccaattagctccttatatgatttagtccctgtgatttctttgacctctttttatcctattctcccactcattccctcagctccagtcacactggcttcttttcaatccttcacacatgagcatgctatccttttaggggactgttccttctgcttagagttttcttttcccaggtatccatttgtctaatttactcacctcgttcaagtctttgctgaaacacctttttctagatgaaagaaggctgccttgattactctgtacttacagcccatcttggctcgtatgactctccatattctgttctactttttttttcttgacagtgcttatcattttcgagtatactagaaaatttattcatttattttatcatattttttcttatcttttccctcctgctagaatgtaagcacctcaagggcagcaatctttgtctgctttgattatcctagccagtatctgtcataatttaggcacaaatattgtccaatgactgaacgaaaaatagatgcttctgatggagatagtaaatccatgtgatccacctggggtggggagcttctgaggaagcatgaaatcattggagcacaacaaacctgcaaagtgggttttgattactccttttatagagtaatcaaagaggttaaatgacttgcccaaggtcacaatgctaataatgccagagcagaactttcactttcatgaatgtcagtaaaactccaagtcatattgttgcatgacagatggttctagaagacagctaattgagatacagtttataaggaaatttcagaggaggtgatgtggtctggtacctaattagaaataagtccccctgaaaggggaatagctatcagcatacaaaaagagattctgaacgatgttcaaggcagtgactgtaagtcaaagtactttaggttcactggccactggttagaaacctgcagatgaggtggagcaacatgatggaataaaagcctataccattagtgtctcctcaggaacaccaaattttaacaaatatccgcacacagaaaagcactttcacaagaaccaaaaatcaggtgagcaatcacagtacctggtgagcaatcacagtaccactcccccatcctctggcagcagctgttcagcatggagagtctgtgcaccgggggaaatagagcacagagactggggtacttcacatggaactcagtgctgccctgtcatactggagaacaaagccgtgctggctcagtcaacactcacgcatggaggaagcatttggacaagacctagccagaggagaatctcccatcccagtggttggaatttgagtttctcagcaagatttagcgatgtgggccaaagggctctggggtcctagataaacttgaaagacagtctaagacacaaggtctgcaattcctaggcaactcctagtgcttagcttggcttacagcccatggtataggatggcatgtgacctggggaatcaccagctggtgcagctaagggagtatttgtaccacctctctcccaacccaggcagtgcagcttacagcaaggacagtctccttccttctgcttgaggaaaggggagggaaaagtaaagaggactttgtcttgcatcttggataccagctaagcaccagacagagtcatgaggcccccattccccctagctcttggacaacatttctagacataccctgggccaatagggaacccactgccttgaatagaaggatccagccctggcaggattgatcatctgttgactaaagagcccttggcccctgaataaccagcagtgatgcccaggtagtatactgtgggcctcgggctctgagatgagctcacttcaggtgtgacccagcacattcccacctgtgatgaacacagcaaaaggctcctgttgagaaaagcagacggaaaagcaaaggggacttggtcttgcacctcaggtaccagcttggccacagtgaggtagagcaacaagcaggctcttggggtccccaggtccaggcctagggtatttgacagcatttctggacttgccctgggccacatggaaacccattgcctggaagaatgagtctcaggtctggcagcattcaccaaaatctaaccgaacagcccttaggctttaagtgaacatgggtggcctggcagaaaccctgcgggccaggggtggtggtagccacagggagaggctcctctgcctgcagaaaggggagggaagagcaggaaggactttgtatcgtgctttgagtgccatcttagctgcagtcgaatagaacatgaggcaaatttctaagattgttgactccaatgcctggttcccagacagcatctctcaacctgcctgggaccgggggaatgtgccactctgaagggaaggacgcaaacctggctggcttcaccaactgctaattgtagagctctagggccttcagtgaacataggtggtagccaagaagtggttacaccaggtcttgggcgagacctagtgttgtgctggcttcaggtttgacctaatgtagtcccagtggtggtggccacaggggtgcttgtatcaccacacccccagttccaggtggctcagcacagacagagagagagagagacagagagagggagactccatctgtctgggagaaagtaagggaaaagaacaagaatctctccctggtattctagagaattcttccagatcttatcccacaacactaaggtgctacttctatgagtctataaaaaaacacagtgctatttcacttggggcccaagtccttctgaatacctggaaaaccctctgaacaaggataagcataaacaagcccagactgcaaacattacaataaataactaactctttaatgcccgaacactgaagaacatctacaaatatcaagatcatctaggaaaacatgtcctcaccaaataaactaaataaggcaccagagaccaatcctggaaaaacatatatgtgacctttcagacagataattcaaaatagctgttttgaagaaactcaaagaaatttaagatcacacagaagaaggaattcagaattttatccgataaagttaaccaagaaattgaaataactaaaaagaatcaagcacaaattctagagttgaaaaatgcaattggcattctgcagaatgtatcagtctcttaatagtagaattgttcaagcataagaaagaattagcttgaagacaggctaattgaaaacacacagtcagaggagacaaaataaaaaaacagtacaaaacaataaagattgcctccaagatcaagaaaatagtctcaaaagggcaaatctgaaagttattggccttaaaaaggaggtactgaaatacctcctttttaataggaatagggataggaataggaatcctattcctaggattcctgaaataggaatagggaagtttattcaaagtgataaaaacagagaacttcccaaacttagagaaggatatcaagattcaagcacacgaaggttatggaacaccaagcagatcttaaggcatgtaataaccaaactcccaaaagtcaaggataaagaagggatcctaaaagcagcaagagaaaacaaacaaataacatacattggagctccaacatgtcttgcagcagacttttcaatggaaaccttataggccaggagagagtggcacaacatatttaaagtgctgaaggaagaaaacttataccctggaatagtatatctggcaaaaatatccttcaagcatgaaggagaaataaagaccttcccaaacaaacaaaaacagagggatttcatcaactccagacctgtccttcaagaaatgtaaaaggagttattcaatctgaaagaaaagcatgttaatgacaaataaggaaccatctgaaggtaaaaaactcactggtaacagtaagcacagaaaaacacagaatattataacacagtaattgtggtatgtaaactactcttatcttaaggagaaagattaaatgatgaaccaatgaaaaataataagtacaacaacttttgaagacacagacagtacaataagacatatagaaagacagcaaaaagctaaacatcagggggatgacattatagtgtttttattagttttctttttgtatgtgtttttgtttgtttatggaatcagtattaagttgccatcagtttaaaataatggcttataaaatactatctgcaagcttcacaataacctcaaattgaaaaacatacaacagatacacaaaaagtaaaaagcaaaaaattaaatcataccagcagagaaaatcactttcactaaaggaaaacaaggaggaagggaagaccacaaaacaaccagaaaacaaataacaaaatggcaggagtaagtccttacttatcaacaataacattgaatataaatagactaaactctctaataaaaagagtggctgaatacatttcaaaacgacccaatgatctgttgcctacaagaaacacatttcgcctataaagacacacatagactgaaagaaaataaagggatggaaaaatatactacatgcaaatggaactaaaaaagagcaggaatagctatacttatatctgactaaataaatttcaagacaaaaactgtaagaagagacaaagaagatcattatataataagaaatgttaatccagcaagaagatataatgattgtaaatatatatgcacctaacactggagcacacagatatataaagcaaatgtttctacagctaatgagagagatagacctcaatacaatagctggagacttcaaaaccctactttcagcactggaaagatctcccaaacagaaactcaacaaagaaacatcggacctaatctgcactatagaagaacattgatctaataaatatttacagagcatttcatccaatagctgcagaatacacattcttttcctcagcacatggatctttctcaaggatagaccatatgttaggtcacaaaacaagtcttgaaacattaagaaaaattgaaatactatcaaacatattctctgaggacaatggaataaaactagaaataacaggaggaattttggaaacaataagaatacaaggaaattaaacaatatggtcctgaattactcacgggtcaatgaagaaattaaaaggaaatttaaaaaatttgttgaaacaaatgtcaatggaaacacaacatacccaaacctatgggacatagtgaaagcagtactaagaggaaaatttataggtgtaagtgcctacaacaaaactaagaaaaactacaataaataatgtaatgatggccaagtgtggtggctcgtgcctgtaatcccagcacttcgggaggccaaggcgggtggatcacgaggtcaggagttcaagaccaacctggccaagatagtgaaagcccatctctactaaaaaaaaagtacaaaaaaattagccaggcatggtggcgggcacctgtaatcccagctacttgggaggctgaggcagggaattgcttgaacccaagaggcagaggtttcagtgagctgagatcgtgccactgcactccagcctgggcaacagagggagattccatctcaaaaataataataataataataataataataataataataatgtaatgatgcatcttaaagtaatctgaagagtccagaggggaggcgatacctgaggaatccttgagtaggagctgtacttctccttgttcttccttgaccaaatcctttggagagcctgacagttgagacccctacccaaagaaattctcaagagtcccaagtagaattcagaccaaggatggcatgccaagattcattcttcactcagaaaagaggggagacagcatatctctagtgaatatggggttctttaaggcctgacaagctgctcagaatactttcccatgaaaacagatatcacttcctgtctgtgctctcaattacttttggatttatgcaatgtgatcccatgagactgggtccactcatggttacattatagctggggaaaccagcactgctttttccctactagaagagccagctcaatgaagaattttcatgcaaacaactacacctagatttactgtctcagagaattcctccacacacctaccatccttacctcactataatccccaccaatttcctagagaaaggggagttcatgagctaaaacaaatgtgatagaactctcagaaatatacagactattacagatatatataatttgtgaggcatgagtcacaattctatttgttttatgatgggataaaactcaaatttttttcatcaaaatgaaaaagaaaaacaatgaaaaatgaaaagatagaattatttgttggctcacactcctgtgggtcagaaatttggggtgtacttagaagagctggctcatcagtactgggactctttcttgtggtcattcatcctcaagatggctagcccaggcttcttcacatagcagtggtagggttcagagcaagagtagaagctgcaagccctcttgaagagtagggtcagaactcatgccctattacttatgagatagtctactgatcaaagaaagtcacaagaccagcccatatttaaagggtaaggcaatggacttcacctgttaatggaaggaactaaaaacctggccgcttcaatctaccacagatacctgccccatcatgtctaaacttcaggaataataagccaaagccagataagacaggaataagctatgttaagatatttgaattttaccctgagagaaaggggaaatgttggaatgacttgagcagggaattgagatggttaaatgtatgtgctagaaatatcacattgactgaagtagagaatgaattagaatggattagagaagactagtagtactgtttggaatgaagaatgaaggcagtagtactgtttggaatcttattataatgacccaagcaaggtgacttgaccgagtatagtggctgtgagaatggaggaagatgcacaaattggaaagatatttaggagacaggagccattagaatccttgtgaagatggcagtgaacataagtgggtaaataaatcaagtagcaatgatggaaattaaaattttaatttttagttataaccttagcttatttacattctgatttctttcaggtcctgtactaatatttgaactgtgcagatggtttcctattattaagcaacattgcctttaaagttgttaaattatgacatttttatatttacatagttaacgggtcactaatacagcagggtgcataaataaaaatcttattcgacaacatggataatgtatttttcctgcttgtttagaagcagaagtagacatgtattctgctggctagcattttgaattaaatagaacaaccaggtcttcataataagcccacaagaacaactagcattcttctggagttttgacttctcaataagctaacaatattcattgataaaattacatgtttctggtctttttcatggccgttacaatttacattctgtatcctgttaacctcctgacaaagtagatttcattttcacaaccaatacaatattgttctattcaggatcgctaacttcatcccttttagtagttatggtatggtgttctcctgcgtaatggtttagtgttgattctcttcctacaaggttttctgccatgatgtagtttcaggagataacaccagtttattacaaaaccatagcatggcattcactcccctcaaggtcttttatttcctctcttctgtgctttacttttgcccaaggggaaaacatggataaaagcaacaacttccaccatgaattagatatctattgaacagtcataccttctgtcagagcatttagttaagatataaatctaagaacaaggtgaatactgtattttgttatgcagttgccatctaattttcacagactgtttccaagtccaagtaatattcattttatctttgtttttattcacattttttcattataaacagaaagtagaggttttaagatgttggtttcagagtggaaggaggtattgtgaagcctattatcttcatatatgcgaatatgtcaaacactttcctccatctgatgttaagaaaatagaaaagcaatgtctgttaaagttgagtaaagactaaagtttcaccttcagacaataattttatctcatcctaaacttgaaataaatcttagtaatgccttcagtccctacaacaaattagctcacattagaaagctgacgaaatatagaacagctgtgtgcacatcattctgcttgattgtacatttcagcccataatatgagtagccttgtatgcatactgaataatccatacccagagggttaattggatggttgctgatatatttatattgtattgattgagaaagtttgagatgagtagctccccaaactacagtaatgaaaaacaaccataatgttgtacattgatgattatttagctacaaaggaaagattacttcctagacctgatttaccatggtactaaaatatatgtttacttcagatggacaaattgaagagcactagtttcagggtaaggctgcaaatgatttctttgagaatcagagaggaatattttcaaatgcaagtttgtttcacaggtaaactgatcatttctgggctgctatctagatctcacttaacaggaagatttgaaagcctatccaacgtgagaagtcctttagcaatgacagcacactcataaaagcaggttgaaagagtgactatttatagaagatagtcatcatacgaaaaaggtatgatgctatagcacctataatcatgtttggtatatactagatgcttaataaatattcattgacatcaaccaagcaatcaatcagtatcaaaagatactggaagtttttaaatgcctgataaatttgaggaatcatatacctgacaacaattctataggcaaagcattgggtgcttaaagaaaatccaaattgaaaatcaatgcaaggcagtacttcattagttaaataaccttgggcaagtcaagtaacctctctgtgcttctttttcctcatctgtaaaacagagctgttgatacatgaaaggcacttagaataatacctggcacatgtaaaattaaataaataccaattattttaatgatgcaaaatatttcatttcattctaaacttctatatttattatagtataaccaggaaaatagaaacaaacctgagtacctaaaacaaaaggaacttcatacagaaatttgttacccaggttatgaaaaatcttagaggccaacagggaatggtgaagtaatcaagaaatcagcagaaagagagatttattatagtcctggaatttaaggccaaagagagcagtaagtataaccagaacaggaacccaggggtcagggccacctagaagaacctgtagccatggccactttctataaagggaactagagttccagagaccaagaaggagaaagagaaatactgacttctccctcttgttctccaatatcttgctagtggcttccattgctcaaaccctgtaggagccatctgacaaaggggccctggaaatgccacctgtaggtgtcagcccctctcacaatacagagcagagcaggggaagtgcaaggaatggatttgagagccaatagaccaaggacttgtaccatcccacactgttgttgccttgtattattgctttactagtctctgtttctaaccaaactgcaaatttctttggcaatagaacctaggcatcattgttttgtattcctaacccccattctcctgtcaatactgtgctttgcacattataggtatttagttgtgagtattgctgaaaatttttcacataggtctgaatcacttgactcctaggatataattttatttatttatttatttatttatttatttatttatttatttatttatttattttgaggcggagtctcgctctgttaccaggctggagtgcagtggcatgatctcagctcactgcaacctctgcctcccaggttcaagcgattcgcctgcctcagcctcccgagtagctgggactacaggtgtgagccaccatgcccagctgattttttgtactttagtagagacagggtttcaccatgttggcctggatggtctcaatctcctgacctcatgatccacccgccttggcctcccaaagtgctaggattacaggcgtgagccaccatgcccggcataattctttttttctctgtgagagcagagatattaattaattatgtccgctgttcttatgcaagatatgcctttttactaagatgcaaggatgaatgcatgctaaaatagctgcatttctgcactgattaagaatgagcaatatatgcaaactggttgcttgaagttctttgtttagaaatcctacttatttatagaactccctaatttactcatggaaaaacaggcctctttacttatgaactaaagcaaaataataattgttatgacaacggtagaaggccaatctggtagcttttacacttgtaactttataaccaacaataaaaaatacattttatattatgacccagcacacacacacacacacgtgcacacacacacaattgaaacagatattagaaaaatgtgtaatatattccattccatttttttaaatgtttgtcaaacccattaaattgatttcccaacccaccaatggattacaacctacagtttgcaaaacacttgtctaataggattatacccttggcagaggttggaaatgcatgtcatcataggttctcagcctctcccgtgagagacgtaatgaaagaggtcagaacacctcctccatctacaggtggaggctgaagagccaggcctgatacaatacctcctcttttctgcccaccatctactcctagttgccagctataagcaatttgggcaagtaaagattctgtccttaagacaaggtataaaacactgaaaatagcatttaattatgtcttagacattgtgtttctttgggtctgaaaccctttaaccagtctctgtgggtcctaaaattttctttttgtgattaacacaagcaaagcacagtttggttcaactggggaagcattctttattctgtcagatcttgaaacaaaaactaaagggactaactaaaaatccttgtgaaaaataaactcaatacaatttggaaatatgttgttattgaaaaacaagaagacttctattatggtaaaaacaagagctcttccctttgagtatcatctcagaatttctggtggttcaaaaaaacaacatttttaagaagttctgttttctcacaaacttcaggatttctatcaagctgtctgaaaacaaaatatttttgttacttaaacacagctggcagatttgagagtgttatacacaattggccatatgtcaaaatatacatagagcataatgcgctttatatggctttaaaataagataattaattaaatgaagaatatagcactattcaggaaagtgaatgtaatattttgaaaacttacacatgaattctcaggcaagtttgttaatagatttttagtgctagagtgaaattacccactcttccttgccatcccagtccacataataaatatagtcattctaaccacagtgttgggatgatatacaattcacagtagacaaatttcatcccataggcacaggctcactacttcaacgacctttatctgagtataaaatttgacatactgtctccaagacaaagtcaatcctgaaatagttatgcttatggaaagaatggataaagggcatgtagataatattataaaatcatttatttctgtctttagaataaaatgaaaagatacctgacaaataaaatacaaatccatgggtagcagcactgcagagcccagggtctgaaggctggttctaattctgactgtcatttaatcatatatcaagggaatgttacttaatttctcatactctctttcctcgccaggaaagtaaggataagaatagaatatatcacaggaagcttctgcaaagattaaatgagattatatttgtaacagggcttagttcagtgcccggaacatagaaagctctcaataaaaattgtcaacaatgaatatacatgctataattgggacgattattatttttcacatattttgcttctccaagctcagctttgagcttctagttccatcacatgattgccaggagcctgggactctgctagatatcaacagatgagacagtggcatattactaagaattgagtgaatgctcatatttatataagatcgagatgcttctgtttcattcattcatagagatttagccatttagcctgaaactctcatcttcacctaatgactagtcacatttgttagagtagtttcatggtgcagctgaatgacacagaaatggtacatcctttttactctctatccatccttacttgacaggctcagttatccagtgccattctctgtgtactcagtcacatcaggagctgcagaacatgagtacacagctcctatggggaaagcccagtggtgataatgctgaagtgccatatgtgaagatgatataaaatcaaatttaggcagaacaaaacaaactgtgattgtcacctcatgcagtgcagtaaatgaaaagaccattaaaatctatgaattagttcctaaactctcacactatgcagatgagataaatttcttcattgagagaacaggattcgagtttgttgacccaaacacaaaaatgtgcttctagatccttgcagcagttcaacattagaggcaatgaagtttgagtaacaatttttcagagtctgataggctaaacagggttgatgggtttccccgtatctgatctgcaaatcccttacggtagttttgagaacagagcccattactgtatcttgacaagggacagtctccaccatacacttagtggtcacaggacattctatctctgtgttgtgaacacagttacctgagggaaatgttgaagccatgtgacttcctcacattatgctagcattgtattgcttattggtgtagaataaatcttgctgttacttaatgcaaagctcctttgctttgagttaatcagaaggtaatttgaaggaactaaacattacatttaagtcactttcaaaatatcttgaatttggacatagcctaaaactttctatgaatgaaaatgttttatatattttacattagtacccaaatcacagttctttgtttaactgctgaaaatagaaatttaaaaggtttcacaaattgattcgtgctgaaaatgatgaactatttactaaaaaagataaattacttaatgtcatctctaaaatagacatcataactctgctgataatgtagaacttttgaaaaaatactattgtgataataaagaacaaaatagtttggcaatttattaagtggtaaactctagcatataaatttaatgtataagtaattttctgcttattgaatatttgtataatttcaaattttaatatttattttcttataataaacaaggtattaattttcattatacaatatataagtgtaccaaatggaattttgtagaaattagggtaattatcttgccctggctcatagtgatttgcaaagtaattttctttaagttattatgaaaaatactcatggccctttctttattctcccaattttatttcaaaattagaccttctcttccttagtgcacgcgcttaccatgccctagtacattgcaccctaatgcaaatctctggtttaatatgaaaattatatttaccattgatagtgtaatttagtatctgtgacaataccatctgttagaatttgaattgaaactctaacacacttctattatgctgaaatgaacacctgtccattaggttctagacctgagaccagggattcattctaaatcatcattgaatagctatccagtgatgacaaacagaccatgtttattcgaataaactaatggcaaaatctcattataaattcaccaaagtgatctattccccttttaaaatgtattgctaatttcttcatcttgtaatataactaaacaaagtgactatttttctggaatttgaataacagaaattattgagtttggtaaactgcatggaaactgaggacaaatttatttgaagacagactgggagaagtacatttttctggtcactttcagtgccagtgcatgtgcctgcctggtcttattttaaaatgcaggttgaggaactgaatataagttacctgtccagcaagtgttacatcacccaccccggatgcactatcctacagggccactgggtattactaagaactctcattccccacctgctatggtctttatgtttgtatctccctaaaatttgtatgttaaaacattaacgcccaaggtgatggtattaggaggtggggcctttaggaaacaatttggtaatagaggcagagccctcatgaataagatcagtgtccttataaaagaggcctgagagagacctcacacccctttcaacatgtgaggacagagccagaaggcactgtgtatgaaccaagaaatgggccctcaccaaacacagaatctgccaatacattgatcttggactttttagccttcagaactgtgagaaataaattcctgttctttaagccatccagtctatggtattttgttacagcagctcaaatggactaagacgctaccccaccctcccctgcaccttacatttacaaatgtttgtgtcctgatgatataaaattgtttcttccattccattccttcactcagtggttaggctattcgttccccaagaagaggggagaacctccctctccagcaggaatttactgtatttcctctgatctagaaatcactgccagtttcttccaggtgattaccccaacacagaatgggatgatatatttatttcaacactaaagtcaaacattagctcagactctgtatcagatattccatttttaaaattctagccataaaattttccaaggtaatttgggaaatatgacttccttctaatagcgtggtagctaagtgtcagtgaccataaactatttcaaaagaaaaaaatgcaagcaagttctgcttgagattagaaggggaagatttgtgtaaaatcaagatgtgaaagttatagcagttcctaacagcaaattttaaggtttgaagatggtggtactttaaagcttaaccttcaaaattcttccatctgctagattaaaaaaaaaaaaattaagcttaaagaaagataacctgaaaaaaaagcactttcttgccaaaatcatttgaattattttttttgtctaaaataattagaatgttttcatctattctgcaggctgcttattttgacacaatggtattctcaagttttagaataatttacttaaagaaaaacataaatctacatttaaaaatactcgctttttaatccaaattaatttctaattatttgggttttctgtgatgctgctgattgagaacaaataaaataagcatgtactagaatgtctattttacatcatatataactcattttcaagctgaggctccaggagaattggacacagaatttggccttttaaatcctcccaaaaaagcacatcttttattgtttttgttttcccctccatcctcacctaaattgtcctttctctgcctctctcccgcagaaatatatatgtatataaatatatttatatatattatatattttcatatattatacatatatataattgtaccaggtactcatgccttgaaaacactgaacagttaatgtcgtttctcccccttcactgaagttactaaaattatttccataaaaggctttacttttccaagaaaataaagattatttatgcaaatgacgattattttcatgatcctactgtttaactctgcagaactagttctttcctattccccttgcatctatcctccacgttgtttcttgtccttgctacttcaggtattttttttcctcctctccttttcaccataccatctggccaattcagcagcaagtttatgaaaacacatttttctgcgtcacaaagaaacaaatggcttgcaaatagatggatatttggggcttgattgtatagttaatgcatgaacaaaatatagatataaatgggaaaggacagagagatagattcagtatccattaatcttcttcaaatagtttaccttttaactgggtacatgaagatacaaccaaagcagaagatgtgggactcgacatagcctttagatggaacctggacatactaagagaattcagcataagaaagcccaattattgattaaatgcacaacaggtttatggtaagtaaaaggaggggctcagaaccttgcgttactttttctggtattctgctattagattccctgagacagcaaaaatgggtagaaaattaggtttagctgaattgctgtgaactgcactgtcttagggaaagtaacattaaacttcctcagtaggccacacaacaggtaatataagtaagttactttgaggtcacttacacatccatttacatcttattctggctgtggctgcctcagggacttgggaaagtatctgtgctccaggtaaagtattagactcactgctacccacagctggtccaggagtttttaaaataaacacaagagaggaaacttgcttaggatctctacctctttacctccaaggtacccaattctctctaacgctccctggccataaagagggttcagtatcatcttctcccccagtatgtcccctatattggcagtcatgctggtcctggagggggccttctgggggtagcagggatctgaccttccataatcttgtactcttcacccaatccaccagacttctttgctactctggttttttgcagctaggctcatgaaagaccaaaaagtgagcagtgcatagtatttgaaagtgaggatggcagcaagaaaaacaaagaagcaatgagccatgtgggttgcactctccaaaggctgcccctctccaacatgtatctcaacattatttctgcaaatgttatggacccagggactgaagaagtttaccacttgtgtgatgaagtcaaaggtgcaaatgtcatggtttcacattcaaagccctctgtgcttgatggatacttacaaaaataatgctaaaaagctgaaagcctactgacatatcccgcagtttactgagtgaatctgcattccatgtgaacctacatgtcatgttctagcacaaagggccacagatcaatgatactctatttattctaaattcacagaaggaaaagttgaaaatataaagagtgaaatcagagtggcttcattttctattcacaatagagtattagcaaaagtattacccacaaccacgatccaaccaacattttctaagagtctttcaaaatctaacaactttgcatcagtcatggccatcatccagaggccctcactctaattcatcctagcttaagtagacctcagtggcagaactttctaatctttccaataaagcagaactttcttttagtttagctaagtcacatttcttccatgtccattgctttaattgcataagagaaagatcactgggatctctatgctcactggcctctttatgtgccaggcccttgattactgctcactcctcagataaactgactctccaattggcctgcgagcagctgtaacttcttaacttcttagttcttattattcttcctctctctctctttctctctctgtttagagacggggtctcactctgctgcctaggccatagtgcagtgacatgatcacagctcactatagcctcaaactctgaggctgaagccatcctccaactcagaatcccaaagtgctaggattacaggcatgagccatagtgcctggatgactcctctctttttaattacttacatttggattttatacaataaatcaaaatttgttcattcggttatccatggaggaaagataccaccagttaggtacccagttcgcttcaccagtcaggtaccctgtttactttaaggaagcatcagtaatcagctctgcagttttagtaattcaattcaccacagattgctcaagtgccaactatgtacttaatacttatattgactagaagtcttagagtaacctgtttaagttaatattagctattcaataactgggatacatttattctagtagattcttaaaacaagttttaaataggacacctatgactatctttttttactggtaaaaggaaaaacacttattctttaataacatgtttggatttatgttattgcatttttgagcaattggaatattaagttccattttatttattctattaattttttttttttttttttttttttttctgagatggagtctcactctcttgctcaggctggagtgcagtggcgccatctcaacaaactgcaacctctgcttcccaggttcaagcaactctcccacctctgcctccggagtagtgggacttacaggcacgcgctaccatgcccagctaatttttttttttttttttttttagatagagacaaggtctcaccacattggccaggctggtcttgaactcctggcctcaagtgctccgcccaccttggcctcccaaagtgctgggattacaggcataagccaccatgcctggccaaattccattttattactgttactgatttctgtcatagtgtaatgaaatgatatgggtttaagatactgaaactttttatgaataaattcacttattaattgaataagtatttattaacctactatgtgtcagaaattctgttagtaaggtgctacgaatataatgatccatgctgtcattaagctttaaggctgtcattaagctttaaggcactgggggatacagaagggtaaatagagagttgtaacataaggtaataaaaggcaatgaggagacgtaaaagtatgataagaataggtagaatgggtttctcacccacccataggatgatcagagatgagttcatttaggaatctaaaatgatatcaaaactgtgacctgaggaatgattataagatattggggctgggaggaatgttctaggcagagaaacagtagtgtgctagcagaatttttcaggcaagttattaaaccatttgcaccttgaaataggccacactgggagtaattatgccgcagaaatctgtgaatgatccaaatcaaggccttccccttctggaagaccagaatatgcctccccaaaataagaaggattgttaagctgaaggcagttaaaaagaaatagatacaggagagctctctgctctttctctatttgcaaaggtatcctaccctcctctctaccaaggagaatgaagtttaaccactgaagacagctttaggctctcatcagcctagaaataataccacaggaatttatagtagcaagctttactaactagcttttatctgtcatttattgacctttctccaagttgccacctaatagagactcaaagttcctttcctttgtctttccacttctctagatatttactgttctttgttgaagatgctgtataagctgggattcaaagccacctctttgaggattactcattttctaggtgtctctgatgtatatatggaatctacatattaataaacttgtttgttttcttttgttcatcttttgtaacacgggtccattctaactacaaactatggggatttttcccctatattcgcctatgccccactcccatctgcagctaatttacctgtactccattggaagtgaatgagagcacagtcaatgaaggaactaaaagttatctcagtttagtggaatggtagaaatgaggctggaaaagtaagtaggagccagatcttgaaggaccatgtaaacaaggaacttggaatttgccaagaggatgaaggggaagcaatgaagagttttaaaggagaaaagtcttcattctgtttgcatatttaaatgcaaaatgtgacagtagtacggagaacattctggaccaataccatgtgaacttcctcagaaacaagttgaaggacatcaagtaatttggaaaacacagaaaaagcattctcaatatgacaagagtacatctgggacagattaatcccatggcatattgtaatagtgtgtgttccacagatggaaaggaaggtaaaatagattatgaaaaatgttttatctgctgtcacctgtaagacaataaccataaatggaagtcatgtgttgcattgaccacaatgtcaatttcagcattaagacccaagagaaagccagccaacagatcattcattcacttactgtgaatataattcattaactgtgacatgattcattaaaatttaccaattaactgaaagagacacctataaaggtaatttggggggcttttattgatggtattttacaattaaattttaaataatgttcatgtcacaagcaatgtgaatatttaactgtatatttttatgattccgtagctttcctggattaaaagaaaatgtataatttattttacaatagacccttgatcattcacaaatttaacatgttcatagcccacattcacttaaaatattgccaatgcccatatgaaatgcacataatcctgggctggtttgggtgttagaatcagtcatttacctagtgaatgagcctactcaacagccctgcatctgtacctcaatgaggttttattgttgatcacttcaatactgacagacttaacagaagaattgaataatggaaggagactacattcttgtctaagaagagtcaacattttaaagattccaatgctttaaaaatataaagctataaattaaaagcaatcccaatataattagaagagaatttttgaagactaaatgtggtaactcaaagctatatatggaaaaataaaggtgtaagaagagttaaaaatttctagaaaagaggatgaattggggagcacagcattaccagataccaccacatattatgtagctatggtaattaaagaatgagatacatataaatcaagagacagagtaatggaataaagaagccagaaatagacctgtataaatttagtacacaataaaggtgacatttcaaactgatacatttaaaaaattaaacattaaaaatgaagccataaaagtagtagaagaaagtatggtatagttttaaaaatagttttggtagagggaaggactttgaaaacatggaaccacaggaaacaaaacatgcaaatttgaataaacataaaatgtttctgcatgatgaagcattataaacaaagtaaaaagcaaataatatgccaaagataaaatatttgtgacatatgaaaaaggaaactttttagtcctatagaaagaacaaatcaatagaaaaaaataaacccaaaagaaaagaggcagagatcataaagatagacttcacagaaaagaaataaaaatatattttaaatatgtgaaaatatgctcagcctcactcatttcaaataaatgcaaattcaaacttcaaagagatacaaattttcaccttcagattggcaaagtatatgacactcatatattcgatgggaaggtaaattggtatgatttttaaaaaggcaatttgacactttatatccaaatttcaaatgcaggtatccttttaaccagcaaatcctactttgaagaatttattcctcatgcacacttgtatatatatgtatgctaagatattcactgtatcattatttgcaatagcaaaaaaatttgaaacaaagtttattagaacattgtgtaataaatttttgtgcattcctataatgtggtactatgacattatcaataaaacaataaagcagatctgtcaggactgaatgggagaattcccaagatacagtgttaaagggataaaagaggtacagaacagtatgtatgtatagtatattactattgtaggaaagagattatacatacagaaaaaatatatgcagttatatgtctagaatagctttggaaggacacatgaaaggaacagagaagagaacaaataaggaagaagcagggttttttgttttaaccatataccttttatagcatgtaattttgagggggtgaaaatcaggagaggctggaatcaaggatagaaagattatgaaaaggtttcagggagtgttccagcaaatgcaaaatatgctcactgagtgaaagatgtaacttaaacaaaagttgaaatggctttcatgtagtacatttcatcatcttcatttatgagatatctgtgatatggtgggaagcatcattattcatagccatcactatgagtaagtagtgctgtaagggctggagctgtcctgtcttaacctgcactgaattcactgggattagcatggtgcttatgtcaaggaagagcagacctggacagtagttaaagaggtaaaaacagactttattaaagaactatcatggtagagggaaatagacttcagtatagaactgtgcttaattctgatacaacaaggaaaagtgagaacttataatcaagtagcagagaaatgagtctgtgaatggaaaattacttagaaggtaggggaattgttgctaaactgatctaacaggattcttgttgaaatcaggccaggatgatcagacaccacttggttgatggtgaaaaatgaggaatttgatcagataactaggctggcaataatagtgagagacttccacaccccactgacaacatcccactgacaacattagatcaatgaggcagaaaacacaaagaaattcaagacctgaacttgacatttgaccaaataggcctaacatatttcaacagaactcgctgccccaaatcaacagactatacattcttctcatctgcacatggcacatactctatgatcaaccacacaattggccataaaacaatcctcagcaaattcaaaaaaatagaaatcataccaaccacactgttgaccacagtgcaataaaaacagaaatcatactaagaagatctctcaaaaacatacaattataaggaaattaaacaacctgctcctgagtaacttttgggtaaacaatgaaattaatgcagaaatcaagaaattctttgaaactaatgacagcataccagaatctctgggacaccgcttaaagcaatgttaaaagggaagcttatagcactaaatgaccatatcaaagagttagaaagatctcaaaaaaccatctaacatcacatctataggaattagagaaagaagagcaaaccaatcccaaaactcatagaagacaagaaaaaaacaaaatcagagctgagctgaaggaaactgagacacaaaaaaacaaagaaaagatcaatgaatccaggaattagtactctgaaagaataaataaaattgacacaccactagctagactaataaaaaaaccagagaagatccaaataaacacaatcaggaatgacaaaagggacattaccgccaacccaacagaaatacaaaatccacaatgctcaagtaggccttatccctgggatgcaagtttggtttaacatatgcaaatcaataattgtgattcatcacataaacagcactaaaaacaaaaaatacatgattgtctcaatagatgcagaaaaggcttttgataaaagtcaatatctctccatgttaaagccctcaaaaacccaggtgttgagggaacataactcaaataataagagccatctataacaaacgcacagccaacagcatattgaatgaacaaaagctggaagcattctccttgagaaccagaacaagataaggatgcccattctcactactcctattcaacatatactgaaagtcctggccagaacagtcaggcaagagaaagaaataaaaggcatccaaatagaaaaagaagaagtcaaactatctctgtttgcagatcatatagcgctgtacttagaaaatcccataatgtctgcccaaaatttcctagttctgataaacaactttggcaaagtttcaggatacaaagccaatgtacaaatagcagtagcatttcaatataccaataacattcaagctgtgatccaaatcaatcatataattccattcacattagccacaaaaggaataaaatatctagaaatacagcttaccagggaggtgaaaggtctctacaatgagaagtataaaacattgctcagagaaatcagagatgacaaacaattggaaaaacattccatgctcatggataagaagaatcaatattgctaaaatggccatactgcccaaagcaatttatagattcaatggtattcctatcaaactacctgcaacatttttcacagaactagaaaaaaaattctaaaattcacttggaaccaaaaaagaacccaaagagccaaagcaatcctaagtgaaaagaacaaatatggaggcctcacactagctgacttaaaactttactacaaggttacagtaattaaaacagcatggtattggtacaaaacagacccatagaccaatgaaacagaatagagaacacagaaataaagccacacacctacaaccatttgatcttcaacaaagttaacaataaaaatgatgctagtataactggcaagtcatatgcagaagatcgaaactggactcttacctttcaccacatacaaaaatgaactcaagatggattaaagacttaaattcaatacctgaaactataaaaactataaaaaccctagaagaaaacttatgaaatgccactttaacatcagccctggcaaagacttcatgatgaagacaccaaaagcaattacaacaaaaacaaaaatcaacatataggatctaattaaactaaatacttttctcacaacaaaagaaacttacaacagactaatcagacaacctatagaatggtagaaaatattcacaaactatgtatctgacaaaggtctaataacccaaatctataataaatataaaacaaccccattaaaaagtgggcaaagaacatgagcaggcacttttcaaaagaagacacatatgcagccaacaatcatatgaagaaaagcttgacatcattgatcattagagaaatgcaaatcaaaaccacaatgagataccatgtcacaccagtcagaatggctatcattaaaaagtcaaaaaataacagatgctggccaggttgcagagaaaagagaatgttcatacagtgttggtgggaatgtaagttagttctgccattgtggaaagcagtgtgataagctgcattcttagatattttattctttttgtggctatcgtaaatggaatagcattctttatttggctcacagcttgaacattactggtatatagaaatgctacttctttttgtacattaatattgtagcctgaaactttgctgaagttgtttatcagatctaggaatttctgggagacactacagggttttctaggtataacatcatatcacctgctaacagagatagtttgacttgttttcctatttcaatgccttttatttctttttcttgcctgattcccctggccaggacttccaatatacattgaataggaatggtgagatgtaccatttctcttaatggcacactaatttttttagttttataaaggactttgtgcctgtatttttgtcattattgtatattatctattttttcagttactctttactgtggttaagagaaaatacgatattaagaaatctacatatttgtgatcatcttaatatagattcctttgccagacaaggttttactacaatgcttatcaatgatggtacagagaccgcctgagatacttgtttgaaatgaagattgctaggctacatgcccagaaattctggtttactagatctcggttggtgtttagaaatacttaaaaattgtctcaggtaattttaatgtcaattaaaattgcaagaccattggttttcaacccttttttttcttacggatctcataataaagacatatggtaaaacaaaacatatctattttttctttttttttttattaaagttctgggatacatgttcagaatgtgcaggtttgttacataggtatacatgtgccacggtggtttgttgcacccataaacccaaaatctacattaggtgtttctcctaatgctctccctcccctagtcccccatcccccaacaggccccagtgtgtgatgttcccttcactgtgtcaatgtgttctcattgttcgattctcacttatgagtgagaatacacagtgattgattttctgttcctgtgttagtttgctgagaatgatggtttccagcttcatctatgtccctgcaaaggacatgaactcatccttttttatggctgcatagtattccgtggtgtatatgtgccacattttcttcatccagtctaacattgatgggcatttgggttggttccaagtctttgctattgtgaacagtgctgcaataaacataggtgtgcatgtgtatttatagaatgatttataatcctttgggtatatactcagtagtgggattcctgggtcaaatggtatgtctggttctagatcctggaggaatcaccacactgtcttccacaaaggttgaaataatttacactcccacaaacagtgtaaaagcattactatttctccacatcctctccagcatctgttgtttcctgactttttaatgatttccattctaactggtgtgagatggtatctcattgtggttttgatttgcatttctctaatgaccagtgatgagctttttttcatatgtttgttggccacataaatgccatcttttgataactgtctgttcacatcctttgcccactttttgatggggttgttttttttcttgtaaatttgtttaagtttctcatagattctggatataagccttctgtcagatggatagattgcaaaatttttctcccaatctgtaggttgtctgttcaccctgatagtttcttttgctgtacagaagctctttagtttcattagatcccatttgtgtattgtggcttttgttgccattgctttttgtgttttagtcatgaagtctttgcccatgcctatgtcctgaatggtattgcctaggttttcttctaggatttttatggttttaaacataagacctaagtctttaatccatcttgagttaatgtttgtataaggtgtaatgaaggggtccagttttggttttcttcatatggctagccagttttcccaaaaccatttattaaatagggaatcctttccccattgcttgtttttgtcaggtttgtcaaagatcagatggttgtagatgtgtggcattatttttgaggcctctgttctgttccattggtctatatctctgttttggtaccagtaccatgctggtttggttaccgtagacttgtagtatagttggaagtcaggcagtgtgatgtctccagctttgtcctttttgcttagggttgttttgtctatatgggctcgtttttggttccatatgaaatgtaaagtagttttttctaattctgtgaagaaactcaatggtagcttgatggggatggcattgaatctataaattactttgggcagtatggccattttcatgttattgattcttcctatccatgagcatggaacgtttttccatttgtttgtgtcctctcttatttccttgagcagtggtttgtagttctccctgaagacgtccttcacatcccttgtaacttgtattcctaggtattttattctccttgtagcaattgtgaatagaagttcactcatggtttggttctcttttgttggtgtttaggaatgcttgtgatttttgcacattgattttgcatcctgagactttgctgaagttgcttatcagcttaagaagattttgggctgagatgatgggattctctaaatgtacaatcatgtcatctgcaaacagagacaatttggcttcctctcttcctatttgaatactctgtatttctttctcttgcccaattgccctggccagaacttccaaaactatgttgaataggagtggtgagagagggcatccttgtcttgtgccagttttcaaagggaatgcttccaacttttgcccattcagtatgatattggctgtgggtctgtcataaatagctcttattattttgagatatgttccatcaatacctagtttattgagagtttttggcatgaaggggtgttgaattttattgaaggccttttctgtatctaatgagataatcatgtggttttcgtcattggctctgtttatatgatggattacgtttattgatttgagtatgttgaaccagccttgtatcccagggatgaagccgacttgatcatggtagataagctttttgatgtgctgctggattcggtttgccagtattttactgaagattttcacatcgatgttcatcagggatattggcctgaaattttcttttttttgttgtgtttctggcaggttttggtataggatgatgctgacctcataaaataagttagggaggagtccttctttttctgttgtttggaatagttgcagaaggaatggtaccagctcctttttgtacctctggtagaattcagctatgaatccatctggtcctggactttttttggttggtaggctattaattactgcctcaatttcagagcctgttattggtctactcagagattcaccttcttcctggtttagtcttgggaaggtatatgtgtccaggaatttatccatttcttctaaattttctagttgatttgcatagacttgtttatagtattctctgatggtagtctgtatttctgtgggatcagtggtgatttcccatttatcattttttattgtgtctatctgattcttttctctttttttattagtctggctattggtctattttgttaatcttttcaaaaaaccagctcctggattcattaattttttgaaggatttttcgtgtctctatctccttcagttctgctcagatcttggttatttcttgtcttctgctagcttttgaattgtttgctcttgcttccctatttcttttaattgtgacattagggtttcaattttagatctttcctgctttctcatgtgggcatttagtgctataactttccctctatacactgctttagttgtgtcccagacattctggtacattgtgtctttgttctcattggtttcaaagaaattatttatttctgccttaatttagttatttacccaagtcattcaggagcaggttgttcactttccatgtagttgtgtggttttgagtgagtttcttaatcctgagttctaatttgcttgcaccatagtctgagagactgtttgttatgatttccattcttttgcattagctgaggagtgttttacttccaattatgtggtcaattttagaataagtgcaatgaggtgctgagaagaatgtatattctgttgatttggggtggagagttctgtagttctgtattagatccacttggtacagagctgagttcaagtcccaaatatccttgttaattttctgtctttttgatctaatattgacagtggggtgttaaagtctcctattattattgtgtgggagtctaagtctctttgtaggtctctaagcacttgctttataaatctgggtgctcctgtattgggtggatatatatttaggatagttagctcttcttgttgaactgatccctttaccattatgtaatggccttctttgtctcttttgatctttgttggtttaaagtctgttttatcagagactaggattgcaacccttgctttttttaatttccatttgcttggtaaatattcctccatccctttattttgagcctatgtgtgtctttgcatgtgaggtgggtctcctgaatacagcacactgatgggtcttgactttttacccaatttgccagtctgtgtcttttaattggggcatttagcctgttgacatttaatgttaatgttgctatgtgtgaatttgatcctgtcattttgatgctagctggttattttgcccattagttgatgcagtttcttcacagtgtcgatagtctttacaacttggtatgcttttgcagtggttggtaccagtttttcctttccatatttagtgcttccttcaggagctcttataaggcaggcctggtggtgacaaaatccctcagcatttgcttgtctgtaaaggattttatttctccttcgcttatgaagcttagtttggctggatatgaaattctaggttgaaaattcttttctttaagaatgttgaatattggcccccactctcttctggtttgtagggtttctgcagagagatccactgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatttgaatgttggcctgtcttgctaggttggggaaattctcctctataatatcctgaagagtgttttccaacttggttccattcttcccttcactttcaggtataccaattaaacataggtttggtcttttcacatagtcccatattttctggaggctttgttcgtttcttttcatttttttttctgtaatctcgtcttcaaactttatttaattaagttgatcttcaatctctgatatcctttattcggcttgatcgatttgcctattgatacttgtgtatgcttcacgatgttcttgtgctgtgtttttcagctccatcaggtcatttatgtttttctctaaactggttattctagttagcaattcttctaatcttttttcgaggttcttcgcttccttgcattgggttagaacatgctcctttagctcggaggagtttgttattaaccaccttctgaagcctatttctgtcaatttgtcaaactcattctccatccagttttgttcccttgctggcgaggagtcgtgatcctttggaggagaagaggcattctggttttcagaattttcagcctttttgcactggtttttcctcgtcttcatggatttttctacctttggtcattgacgttggtgaccttcggatggagtttctgtgtggacatcctttttgttgatgttgatgctattcctttctgtttgttagttgtccttctaacagtcaggcccctctgctgcaggtctgctggagtttgctggaggtccactccagaccctgtttgcctgggtatcaccagcgtaggctgcagaaaagcaaagattgctgcctgttccttcctctggaagcttcgtcccagaggggtacccaccagatgccagctggagcactcctgtgtgagatgtctgttgacccctgctgggagttgtctcccagtcaggaggcacgggggtcagagacccacttgaggaggcaatctgtctcttagccgggttcgagcactgtgctgggagatccactgctctcttcagagccatcaggcagcaacgtttaagtctgctgaagctgcacccacagccaccccttcccccaggtgctctgtcccagggagatgggaatcttatctataagcccctcactagggctgctgcctttctttaagagatgccctccccagaaaggaagaatctagagaggcagtctggctacagaggctttgcctggctgtggtggactctgcccagttcgaactttctggcggctttgtttacactgtgagggggaaaccacctactcaagcctcagttattgcagacgcccctgtccccaccaagctggagcatcccaggtcaacttcagactgctgtgctggcagcgagaatttcaagccagtggatcttagcttgctgggctccgtgggggtgggatccactgagctagaccacttggctccctagcttcagccccctttcgaggggagtgaatggttctgtctcgctggcattccacgcaccactggggtatgaaaaaaaaaaaactcctgcagctagcttggtgtttgcccaaacagccacccaggtttgtgcttaaacctcagagccctggtggcgtaagcaccagagggaatctcctggtctgcgggttgcaaagaccatgggaaaagtgtactattctggccagagtgcactgttcctcatggcacagtccctcatggcttcccttggctaggggagggagttccctgaccccttgtgcttcccaggtgaggggacaccccaccctgcttcggcttgccctgcatgggctacacccactgtctaaccagtcccaatgagatgagcccggtacctcagttggaaatgcagaaatcacccgcctactgcgttgatctcgctgggagctgcagactggagctgttcctatttggccatcttgccagccacccatatcttgtatttttaaaaatttttccaccctggctaacacgatgaaaccccgtctctactaaaaatacaaaaaaattagctgggcatggtggcgggcatctgtagtcccagctacttgggaggctgaggcaggagaatggcatgaacccgggaggcggagcttgcagtgagctgagatctcgccactgcactccagcctgggcgacagagcgagactccatctcaaaaaaataaaaaaaataataaaaaaataaaaaatttttgccaagcattcttaatgtgctaactttgtaccaatcactgatcaaagtactttacaaactcagttaatatctacaacaaccctatgaggtagatactctttatctttctattttacagatgagaagaatgagacatagagatttttttaaaaaacttaagaaaagtaaaatacacagggacagaggataaaacagtggtgacaagggatgagggctggcaggggaggaggggagatgaagaagcgtaggtcaaaggatacaaagtagcaaatgtgtaggatgaaaaattctagagatctaatgtacaacatgaagactatagctaataatattatattgcatttgaaatttttgctgaatgaatagagtttagcagctctcaccacacacgcacacacacacacataagtatgtgagattatagatatgttaatttgctccagtagactaaccattttgctatttacatgtatcctgtaacatgatgttgcacacctaaaacatattcaatagattttataaaagaagaaaaaaaagaaaaacttatccaagttcacataactagtaagccaaacctaggtgatcccagagtctgcactgaactgttttcttctgaaaacattttacaacatcaaaattgttccaatattgcttgacgctctagtaaatatgcattcagtgacactggattacacagaaagcaaagcaacaataacaaaattttaaaattgagatttttgggcactgcaacatattcagccagaaactttttagtttaagttccatagttcattctcttttcaaatatgacatttcctaattcagcatcacagattttgttcaggtatagtattttggagatttgaactggaaaagttgagcaatacatatccagatcaaagggggaaaaaagcaatttgtttatctaatgaaaattcagacagattctgggcatattttcatgggctggatttggaggtctaggattgtagctttgaagtacacttcaaactttaataataatccttgtcttagtgtttgtctgtgttgcagtggccaaatgtgtgaactccagagttttaaatgctgttgtgctcctgctgtcatgcctgatgatacaacaattgatcatccaacacaaagaataagaaggcctgacgcctgtagagatcaaaacaactactatcaaaaacacgttacatgatcatgacccatcaaatagtgctagatatctggattgatcaagtccccagaataaaatggtgcatccttcatcttagtttgaagaatgaccagaatgggggagggagcattaaaatgaaaaatggtcatgctggcagctctgctgtgagggggaatgaaaagtgagaaaccacacctgcaagacaataagggctccagaacaaactgtaagaaaccaaaccataattgcagactattaaagctcaaagtcttgaacaccagctccttcagacccatagtttcttgagaaaagcacagacaagctgatctaacactaacaacaggaactctgcagagatcctatattataaaaataagttcactgactatctaactactcctttcttttcagatttggtccagtttctgccaataccatcctgttaataacttcagcctccaaaattccctaagcacccccttccaaactcctttgaggcacctcagttcccctggtatgcattctcccttgctggaagcagcaagctaataaacctgactacagctgtgctcctggtagtgtttggttggctgtctttaacacctttgttaacacaaaggaagaagccctctaacacaaagtgatcttccaatcattcttccctatcatgtatagagggtatacagagaaatatatatatacacatatatataaaattcaagtgcattccatactcctatattgactactactaacactattctatggtactgatttcattgatgctatgttggtgattatatgtttgtatacatgatccaaattagcataggtatatgctttttatggaaatgtgagtttgaccacattcaataatattatgagtctattaatattgagtcagactctgtgtactcaacaatgactaatccatcatttttcagaagtcatttaagtatttagagatctataactctgcagtgctttgcatgagaaatgtgcactctctttgccttacctcactagacagtcaccgatagagaacttcagtgtctagccctgtcacttcgacatctttcctcagagctaaatttactttcagtaataaagatgcatgaaataatttttcaaactttatatattagatctttgtctctatttgtctgtccatacacataaacactctgtctctacacacacacacactttttttttccttagaaaagtaaccccttttagtatatttttgctaactgaatacactagtgagaagttgccttttaattatttgtctcccataagcaagcagccatggccttcttaattcattttgatagaatattggaatgctggaactataagtgatattagtgattgtaacagccagggttctccagaaaaacagaacataataggacacacgcacacatacacacacgtgcacacaccagcctattcaaagtgaagcgtgaagatgacaaggctaaatatgacttacatccacctaatgaatagcaaatatattttctctttctgatgattttcttaacaacatgttattttctctggcttactttattgtaagaatacagtataatacatgtaacctacaaaaatatgtattaattgcctatttatgttatccataaggctgcttccagttaacagtaggctattagtaattaagttttgaggaagtcaagagttacacatagcttttcaactgtatggagaggttggtccctctaactctcacattgttcaatggtctgctatatatacatatatagtctcttcactttaaggattttttctcttttttttgagatgaagtcttgctctctcatacaggctggagtgcagtggcgtgatctcagctcactgcaacctcctgcttcccgagttcaagtgtttctcctgcctcagcctcccaagcagctggattacaggcgtgcaccactacgcccagctaatttttgtagttttagtagagacgggagttttgccatgttggccaggatggtctcgaacccctgacctcaagtgatgtgcccaccttggtctcccaaagtgctgggattacaagtgtgagccaccacacctggcccactttaaggaatttttttaaagaaataagttcataggattgcaagggctggctagtcctgaatctgtagtgcaggccccaggccggaaattcaaggaggaattaatgttgcagccttgaggtagaatttcttcttctttggaaaacttcaatttctgttcttaaggccttcgactgattgtataaggcccacgcacattttcaagggtcaactcctttaaagtcaactaattatagatgttagtcaacatctgtaaaatactttcacagcaactcctaagtagtgtttgattaaataaaggggtactatagcctggagaagttgacacataacactaactactgtagagatcatctaaacaaactcaattaattttatacatggctagtcacctaactaatacatttatggaatactagaacgcctaaatctattcatactagactgagagttctcaccaatcaaaaaccttgatatataccactgtatttgtaaacagacaacagttcctaagtatttgctgttcatggaatttcttatgcttgtgattaatgtggaaagagtatcctgagattgttaggagcactttattaaaggatatattacatggatcaaccaactgctattaccaggatacgcatagtaaatttactgatgcatttgtaagtcttaagaatggaatgaaaatatttgaaacacatacaaatattgttgagctgttttataaattgggtgactaaagaccactaagttactttttattttacctccaacttgcaattatactttaataaaactgtctaatagtttatatataaaataaattttgcttaactcacatttacttacttcacaaatcaggtaatattaagatgtgtcatttataagaatttgcatttttctttactcagaatgcttacaggcttccagtgagattgtatcataaattagtttctaaataatgctaaaaaattcattggaaaatattttttataatggaaagtgggatttctaattagatcatttggctttgttacaaaatgtgtagtttttaaaatcaaggatatattgctgtgagattctcaatattcacctttttgaaaaactagaatatctgtaaatgaactagatattggataaaaagcataacatgacataatcttttaggtcataggagaagtccaaacatttcattagtgacttcatcatttagtcagaaaagaagactttggtttccttaaaatttttggtaaaatatcagcaacaattcaaaaaattactcaatatgtaacaaaacaaaagaaaaaagacaaaaatgccaagttaaaaaaaacagtgggcaaagaatacaaacaaggaaattcgaaacaagaaatgtgaactcctaatagaatataaaacaagtttaattgtactaggattaatactataaaaattaaaattagatattttcagcctactaaattgtgaagtagtaaaagtactaactttagtgttggtgggatatataccttctgtactactgttggttatagacatttgtaatttcttccagtaggtcaatttggaaatctttataaaaaaaaaaatcttggaaaaaatgcatccttttcatctcagtccattttctattacttataacagaatatctgaaacttgataatttataaagaaaatgaatgtatttcttacaattctgaagattgagatgtcgaaagtgagagccttcttgctggtagggactctacagagttttctgaagtcgtgctgggtatcacaaagtgaggtggctaagtgtgctagcatgccaactcagatctctctttccctccttataaagacactagttcccctcccatgacaacacattaatccattaacccattaatccatgaatatattaatccattaatctgtcttcatgactcactcacctgttaaaggtccaagtctcaatactaccacgttgaagattaagtttcagcatgagtttttggaggatacattcaaaccatatcattctttttcttagtaatttaattcctaggaatttatcttaaggatattattgaataagtggacaagaatggatgtagtaagatattcatgtttgtaataattataaattaatataaaaaggaaaattgctctataagttacagtttattcatgcaatgaaatactctgcagcctttaaaatgttgtacatgaatatttaatgatgaaaagtcaggttatttaaaaagtatacatagcatacataatatgattccagtttttaaaagtatgacggtatacactgaaaaatgtctggaaatgcaaaaagcaaagtcttagtagttgatttggacagtgggatgaccatcgttgtttccttcttttggcttactttcattttatgtaccttgaataacatgagttttcttctaataggaaaaataatgagttatttttaatttaaaaagaaaaagatgtgcccaataaaaaaagatgttactaaacagtagatgtttactttccaaaccagagacatgctgctatgaactgaattgcaccccccaagccctgtcaattcctgcattgaagccctaacccccaatgtgactatatttgaggatacagcttttagaatgtcattaaggttaaactaagtcataaagatggagtcctaatttgattagattggtggtctcataagaagaggaggacagagagatctttctttatctgcacaggctgaggaaagtccctgtgagcacacagtgcaaagatggctgtccataagccagaatacactggcaccctgatctcaaacttcccagcttccaaaactgagaaaataaactttacttgtttaattcacccagtctatggtattttgttctggcagcccttgccgactaagacacatgatttcagtcataaattttaccctgcctgctccctaaaagatttaaattggctaaaattgggctaccattaataaattctgttaagccaggggaatgaacttagtctagactctgaagaggatgttgtctttggaagagctgcaaggctggtatgaagatgatggtggaagcagtataagcaatggcatgaaagtggggcaatatgaggcatggccaggggataagatgcagaccaaggaaagatgaccagatggttgggttctcattctcatgaaatatcctttcaaaatggttaccaaactttcacaaattgacaaagagaagctgtcaggtactataatatcctttgatatatttgtattttcagacctaggtcattctgccaacgcagtgaaggatgacaaggaaagagaaaagttagaggcaaaaccaatctcatgtgatttcagccactgatttaaagaaagaaaaaaaaccctttcaatcagaaaatttttaaagataactttaaaatagcccttgaaacagatgaattaaatgttttctcactatgttatggcatattgtatatatgcaacaaatattttctcataagtttccccatgcttctttaatacaaccctgccctaattatttttttggtcacccattaatttggaggaaattcttaggtgtctgtttttgaagtcatctcttcatgcacccaaattgttctgacagcatcagtctatgctttttaaaactgatatccacttaaattctctactgtttcatgaccagcttgttctatgctccttccaggaagcaatggaatctctatcctagcatctacaaaaccccatgtacatctaccgtgcaatataataacaatgataatataaatatttggctgaagcggagataagtgaggcagaacccatgaatgtctcaattgccactttgatatgctgtctctgtctatcttgagtcactgtcctgcataaagtgttgaaagtgtaattaaaagattggcataatagttctaattagcaagacgtcgtgcaagaagaaattaattttaaagttgtgataacaagctcattggcctcctatgtatgttagatttggtgggatgcttatagaggccatgtcaatgtgactaattggctgtgggactgatgcaattggttaaactgattctctacaggttgtctcaactgcttatgagttctggattcagatgttatgggtccttggaactaaggtgctgcagtgagctagactgctgtcctgtaatctatatgagtcatataactgagaattgtttttaatcttcttccattcctctaaccccatcatcactgtactacttgcaaatcctccagtcatctgaatgctattacagagccaactaaatggagaggattcatttaactgacacaaaagagctctgagagtctcctttccccaacctcattctgcctaaattaccacatgatgaacatgcatttatttttgtaataataattagcattattgcagttcatattttccaagagcagtaatatttcatttttaaatctccatggctttatgagttaggtcagtgttttttctgtataacaaatttggaaactgaggcatcatggggttaaaatgcaaatgacttactcatagtcacagtgccgggattaaagcccaggagaaatgacccaattctgggttcagaccaatgagcaacactccttcctcacctgagttttggggtttatattaattttagcttataatagtgtgactgctacctaaaagcaattttctatagatctgagaaagtttcatatccatcatgctaagcaacattctaaaatcatttctacctttttaactttgtaatttatctttaaatgcccatatgcacccaaggcacatacatctaggaattgctaacatgtaccacaatatttttattgcacattttgaacaaaagaattagctaaaaaattagataaaatgaaatcaaattggaaagagaaaaaaacaacacaaatctttccttacaatttagtcaaactgaaggctactatagacatgaaaatatgctataacttagaaaaccttaaattcttttgataaatacctctctgttattccctaatttcttcagaagggcccctaccaaatcttaaatgttcatatttttgtcgatgtaatataatttccccgttttaataagtggtgtgttatatttttattgaacttattttctgactaccgttttcagttccaaatggtcctgatgttctttggaagagtgtccaaagaaaacaaacttttttttagctctctctctctctctctctctctctctctctctctctatccatatatatatatagatagagagagagagagatagataggtagatatacacacacacaatatacacacacatacatatacatgcacatatatatttatatatagttaattgacaagataaaattgcatacatttatggtttacaacatattttgatctatacattgtggaaggacaaaatcaagctacttaccatatgcattacctcacatactgtcatttattttttgtggtgagaacacttaaaatctactctcttagcaattttcaagaacacaatatattgttattaattataatcaccatattgtataatagatctcttgaatttactcttcctaactgaaatttcatatcctttgaccatctctccaaccctccccctgctttcagccccaggtaactaacaactattctttttttttttttttttttttttactttaagttctgggatacatgtgcagagcatgcaggtttgttacataggtatacatgtgccatgctggtttgctgcacccatcaacccatcatctactttaggtatttctcctaatgctatccctccccttgcctggcaccctctgacaggccccggtgtgtgatgttcccctccctgtgcccatgtgttttcattgttcaactcccacttatgagtgagaacatgcagtgattggttttctgttcctgtgttagtttgctgagaatgatgggtttccagcttcatccatgtccctgaaaggacatgaactcatcctcttttatggctgcatagtatttcctggtgtatatgtgccacattttcttcatccagtgtaacactgataggcatttgggttggttccaagtctttgctattgtgaacagtgctgcaataaacatatgtgtgcatgtgtctttatagtagaatgacttataatcctttgggtatatacccagtaatgggattgcttggtcaaacggtatttctggttcgagatccttgaggaatctccacactgtcttccacaatggctgaactaatttacactcccaccaacagtgtaaaagcattactatttctccacatcctctccagcatccattgtttcctgactttttaatgatcaccattctaactggtgtgagatggtatctcattgtggttgtgatttgcatttctctaatgactagtgatgatgaactttttttcatatgtttgatggccacataaatgtcttcttttgagaaatgtctgttcatatcctttgcccactttttgatggggttgtttttttcttgtaaatttatttaagttccttgtagattctgggtattagccctttgtcagacggatacattgcaaaattttctcccactattctactctgcttctgttaattctacttctttaggttccacatttaagtgagatcatgtggtacttgtctttctgtgcctggcttatttcacttagcatgatgtcctctagattcactcatgttgtcactaatgacagaatttccttcgttataatggctgaatagctctttcccatcttgcatgatggcaggtgaaaaagttgacaagccagatactaaggagaagaaacccaaagctaagaagtctgacgctggtagcaaggtgaaaaagggtaccctcaaggctaaaaagcccaagaggagaaagccccattgcagctgaaactctgtccttgtcaaaggaattgccagatattcccaatctgctatgtattccagaaaggccatgtacaagaggaagtactctgccgctaaatccaaggttgaaaagaaaaaggagaaggttcttgcaactgttgcaaaaccaattgatgataacaagaatagcagtaccaggttggttaaacttctcaaagggcctagatattatcctactaaagatatgactcgaaagattttgagccatgtcaaaaatcccttcagtcagcacgtgagaaaactgtgagccagcatcacccgtgggaccattctgatcatcctcactaggtgccacagaggcaacagggtggttttcttgaagtagctggctagtgacctgttacttatgactggacctctggtcctcgatcgagttcctctacaaagagcacgttggaaatttgtcattgccacctcaaccaaaattgatgtcagcaatgtgaaaatccaaaaacatcttactgacatttacttcaagaagaagaagctacagaagcccagacaccaggaaggtgagatcttcaacacagaaagagagaaatacgagattacagagcagtgcaaagttgatcggaaaactgtggactcaaaaattttaccaaactcaaagctattcctcagctccagggctacctgtgatctgtgtttgccctgatgaatggaatttatcctcactaattagtgttctaaattccttaagaagaacctaatgaaataacttacatatttaaataaataaaaaataaaggctgagtagtattcctttgtgaaaacagtcatttttttaacctttaccttctgtgtggaccgatagcacttacaatagtattgtcagaaatctttctttatggtttgttgttccaggagcctttacaatcttgatttatcattttttcagtagaatatcatcaactgtcctattcatcatagtataatattcatgattcaagttaatctgtgactatagtggtctttcaagcttatttgtttattgtcttatatctcagtttgagtaggttactatggcaacaggcactatagaaatgtacaagataaataatggattatgaatcttcacaggtgtccagctaggatatttttaatgaaaagccactctaaaattgaaagaatctttctcatatatatgttatcacccacatgttgaaaccactcattgataaacaggtatgcctatcaccaaaaagccaggtgagttcttctcaatttagaaacacactttaggaagttactttaggtttgcacttagcaaaataattaaactagttttactttatttctcttaaagttgccaagcctaaaagcatcacaaacactaaatgggttcattgcttttcttcatccatcttagctcaaatcagatgtggcttaacatttgctctataacaagcatttgtatgtcttgatgtacaaatttcataggcaaattttaaaggaactttgacaaatggcaatatctgtagatgggttgaagcccaggagtatgagaaatctggaattcattttgtgtacagaatagttaaaggagcagggtgaaaaaagacaacagagcacatgagagctgcctccagggtttgaagattcagtgaaagagacaacttattctgtagctctctggaatgcaaaaatacaatccaagtgtagcactgagaagaggtaggtttggtttccacatacaaagtggctgtgcaacgccaagagctcgtcggtatagaaacaacggcctcatgatgtagtgagctccctgagagaattcctggagggcgggatgcttggaaaagaaagctgctaggatcccttcaaattccgttacataattcttggataagaattgtgaacatttggtgagctaccatatgttttacctattttagctcatttcatcctcacaagaatcttatgaagtagatactagtattacataaacaaggaaactgagtggcaacaacaaaattcaatactttgtccaagggcacttgataggaatagtagatttggaattcaaaaccaaataatttgatgccacagccaaagctaacgactatgccacagagctcttcaaactgagtggcgcgttggttctgtatgaccctaaatgtctccaaacaacccttccgaagtctatgtctattaatagtctcatctttagcagtgatgctacatatcacaagtgtatgtggtgtctaaattcaactagataactagaagtacaactattatctttgtgtgtttgtgtgggcatgtgtgtatgtatgtatgttagggaagcagtctgagaatatttgggcactgaaaatgagttatcatgtatttgcacttaaagcttctgtcttctgtccacttctctatcaacacttttttattgggtgactcatcttgtctcatggctttacatgctatctacatattgatttctcaaatttaaatctccagccctgactccccagctttgatctccagatacatctatattcctgcctgcttatcatggatgtccaatttgggatgcccaaagtacaattctttccaaaagcttacctatgtgtataggcttttaccagaaataaatattttatctctctttttaaattgagttttgcctttccacattatactaatacataatgaatatgattttacaagttccattttcattttccagggcacagtaactcaaaccgtattatctgaaagctgtgttcgatgtcagttatttcaaatactctttccagtgacgtcagcaagatggctgactggagttacctggtacccgtcactcccacaaagatgaattaaaacaatgaataaacaactgtattttgactagagtgactgaggaagtacactggagagccccaggggagcagggaaatccttgtgaagcatggaagcccttgataacaccacagagaggggagcgaggcatcctgactctgccacaaagtctccccttcctgaatgagctcagagtcaggggagacattttcttatagagaaaaagcaagacagagatccccatcagtccccactgctgccacatacaccagccatccttgctatctaaaagttccttggtcctcacaggccccaaatccagtttggagagcagctggaagtacatatagctacactgacttagagtagaaacccaccttgagcatcttccaaccctaagactaagcacctatggtttggggcaatcttgaaattggacccactgctaggcatcctgcaccaccatcatgacaaactcctacagcctaggctactgaggcaataacagacatcactaattcggattacaactgaaaaagcacagggatcacactaatgaatctactcagaaaaaaaagccaacgtcccatacccaaacaacaccctagggagtcatctacaggcaaaagtctctctctataaaagttactctataaaattagaaaaagctactattccactagatgtgcagagatcaatgtagggacataaagacatgaagcaagaaaacatgacaccccgaaatgaatacaattagtctctagtgacagaccccaaaggaaaggacatatataaaatgcctgaaaggatcaattcaacaagaggatataacaattgtaaatacatatgtgcccaacaatgaagcacccaaatatataaagcaaataatattattagacataaagggagagacagatgcaaaacaataaaagtagggcacttcaacacccctctttcaacaatgggctgatcatctagataaaaaaattaacacaaacagcagacttaaactgcaccacagaccaaatggccctaacaaacatttacaaaacactccatctaacagctgcagaatacactttcttctcaactacatgtgaaacattttccaggtagatcacatgttagaccacaaaacaatttttaacaaatttaagaatatagagatcatatcaagtatcttttctgaccacaatggtatgaatctagaagtcaacaattagaaaaactttggaaactttacaagtatgtgaacattaaacatgtttctaaacaaccaagagtcaatgatgaaattgaaagggaaattaaaaatttccttgagagaaatgagaatggaaacatatcaaacctatgtgatctaggatctaaagtttatagcaacaaatgtctacaccaaaaaataaagatatataataacctaacaatattgcacaagaaacaaggaaaacaagagcaaactaacctaaaattagtagaaggaaggaaataataaagctcaaagcagaaataaacaaaatggagactaaaaaccaattcaaaaaatcaacaaaatagagttggcttattgaaaagataaataaaatggacaaacctttagctagactaagaaaaaagtaagaaggctgaaataaatacaaccagagatgaaaaaggagacattacaactgataccacaaaagacaaagatcataagagactattatgaatagctatataccaacaaatttaataacatagaagaagtggataaattcctgaacatacagtgtaccgagattaaattatgaaaatatagaaaatctgaacagaccaacaacaagtgaggaaattgaatcagtaataaaaagtcttccatcaaagaaaagcccaggacctgattgatggcttccatgctgaattctaccaaacatttaaagaagaatgaataccaattcttttttaaatactccagaaaattgagaaggagggaatacttccaaacccattttatgagatcagtattagtctaattccaaaaacaaataagaacacaacaaaaataacaaaattacaggtcaatatccctgatgaacatagatgcaaacattctcagtgagatactagcaaaccaaatccaacagtgcattaaaaagatcattcaccataatcaagtgggattcatgccagatattcagggatgatttaacatacgcaaataaaaaaatttgatccaccgtattaacaaaacgacaaaaagcatatgatcatttcaaaagatgaagaaaaagcattgacagaattcaacaaccattcatgattaaaaataaatctctaaaaattagatatagaaggtatctacctcaacacaacaaaggccatatataacaaacctatagctaacatcatactcaatggtgaaaagctgaaatctttttctgtaagatcagaaacaagtcaaggatacccactttcaccatttctattcaactcagtactgaagtcctagccagagcaattaggcaaaagtaagaaataaaaggcatccaaattggaaaggagaatatcaaattgttcctgtttgtagacaatgtgatcttatatatagaaaactgtaaatacatcagcaaaaaaagaaaaaaaaccttttagaactaataaatgaattaagtaaagttgcaggatacaaaatcaacatacaaaaatctgcagcatttatatatgctatagtgaactatccgaaaaagaaatttaaaaaccagttccatttataatagctactaaaaataagatacctaggaataaacttaaccaaggaggtaaaagatctcaacactgaaaactataaaactttgatgaaagaaatggaagagaatacaaataaatggaaagatatcccatttttatgaattttaaaaaacttatattgttaaaatggccatattaccaaagagagctacagttttagtgcaatccctatgaaaattccagtgtcacttcttgtagatatagaaaaagcaatcctaaagttgatattgaaccacaaaatacacaaataaagctgggggtatcacactatctgacttcaaaatacactacaaattatcacgtgtactccataaatatttgcaattattatgtatacataaatataagaatatataatacaaaactatactgaccaaaagagcatggtgtgggcataaaaaaagacacaaagactaagggaacagaatagagagcccagaaataaattcacacatatacagccaactgatttttgtggaaaaagtctatttaataagtggttctgggaaaattaaatatccacacacagaagaatgagactagacacctacctctcagtatatacaaaaatcaactcaacatagattaaagacttaaatgtaaaacctgaaactatgaaactactagaagaaaaataggataaatacttcatgatattgggctgggcaaggattttttaaataagacctcaaaagcacaggcaaaaaaagcaaaaacaaacaaatgctgttatatcgaactaaaaagcttttgcacagtgaaagaaactattaacaaggtgaaaagacaacctacacaatggaagaaaatatttccaaactatacatctgacaaaagattactattcagaatatataaggaacttatacaattcaacagcaagaaaacaaataacctaatttaaaaatggacaaaagaccttaatagacatttctcaaaagaagacatacaaatagtcaacagatatgtgaaaaaatgctcaatatcaccaatcatcagggaaatgccaatcaaaaccacaatgagataccaccttagttgactattatcaaaaagacaaaagaaaacaagtgttgatgaggatgtgcagaaaaagaaacttagacactattggtggaattgtttactatcacagccattgtggaaaacagtatggtggttccttaacaaactaaaaatagaactactatatgatcccacaatcccaccactgggtatatattcaatagaaatgaaatctgtatgtcagagagatcgtggcactcccatggttactgcagcactattttcaatagccaagatatggagtcaacctcagtttcaataaatggatgaacagataaagaaaatgtggcaaacagaccgggcgttgtggctcacacctgtaatcccagcattttgggaggccaaggtgggagaatcacttgagcctaaccttgaattcctattcaaggttatagtgagctatgttcatcccactgcactccagcctgggagacaggtctcaagaaagagagaaaaaggaaagggaaagggaaaaggaaaaaagtaagagagagaaagaaagaaaagagaaagggagagaaagaaagagagcaaaagaaaaaaagaaaatgtggtatatatacacaatgtaatactattttgcgataaaaaaagaaatcctgtcatttgtggcaagatggacagatccaggggttgtcgtgttaagtaaaataagccaggcgtagaaagacaaatactccatgatctcactcacatatggaaactttaataatgttgatatcatagaagcagagagtacaacagtggttaccagagactggggagggaaagaggaagaggtgtaaagggggaggttgatcaatgggtacaaagttacaattagataagaggaataaattctgctgttctattgcacagtagagtgactggctaacagtaaaatattacatatcacaaagtaactagaaaggaagcttttgaatgttctcaccacaaagaaatgataaatgcatgaggtaatacactaccataattcgattactatacacatagatatgtgttgaagcattaaattgtaccccataaatatgtacagttacaatgtgtccattaaatacattaaataaaaattaaacaatactcttttcacctttgaaactgtatgtacaccttttacaaggtataatgtttcagaattagactgaaaaataggaagatataatgagctatcattctagatcccctttgttctttttctgtaataaaataattatcatttctggggaaaataagttgtcatacctaaaaagcctgggaacatgataatctagttgaaaagcataaagactggaatcagatacacctgggtttaatctgccattcacaggctatgtaactctagaggagttgcttagcctctgagactcatttcctgatttgtaaattgggatgttacaggattttattggattgaagtaaaatattccgagcctagtgcctattacatagtaggcttgaaatagttgttcacctgccctctcagcactcccagaaaacattcttctgttatagagtatgagtgagggagctgaatgtaaaagtagagagttgatataaactcttggacactctggttcagtgtgttatgttcccttaaactcttaattatgtctttccctttagagctttaactttgttgtatatatataaaaaaaaactctgttgcattgcattcatattttgtgacttattttgactgctattaacctgtcaagtatttgttcttctttaaatttatattttaaagggtatgttacattctttctcatgattttatcagagcttgaaagcaaaatcttattttgaagaagacattgtcaatgttatattgaagccaataaaaaaattggatatgcaggaaaaatattgcttcacaggtaaattttaatgtttaaaatatgacattttcagtctctatctgcattgtttatctcagaatattcagaatatgatgagtggctgaaagtgaatctgaattctctcctactcctgggcagtaataagcctataactttagaaatgtaatgaggaacccaaactaaaaaagaaacaaagatttttcactttagttttgtgcggattttcagaaagaagcaaaagaaatttgcagatttggctcttgagcaagttacatttaacatgttggtatgagaacaaatgtgacaattaaaaacaaccaaatggttacctagtttagagagcagagagggaaaaaatagaaagtaacaccttctgtggaagtaaaagaacaaatggcaatgctagaaatggaattgcatcaatatagttctttttccaatataaaatgccttggaaacttacagcaaataatacaaacttgacagaatatgttctcagatttactttctatatcttataaaaagactaacaggcagttcaagcatcgtgtgcaccttggcttttcttttttatctcttagccagttggcttgctattgtccctttcctactttcaccacttcctccactgtgcagtacttacccttgctcttaacaaatacagattgtactcatgagaaaacatattgctctgaacataccataaaacaacaaattttagcccagcttttcttttccagtgttctacaaattgtggcctaagaaatatctgcagcagaattacctggtgtattcattaattcttaggctccacgctagacctagtaaatcagaatctctgaggatagggcctggcaatccacaaattaaacatactttcctagtgattacactcaagttggagaaccacatcacccaatgatcatttatttaaacttaacatgattcaaattactgagacttccctcttccaaagacactcttttaaccacaagagggacagatgagaagagtagaaagcccggggctacatgctggaagacaagagaccaactcctgcttctaacacttcatgagcatatgatcgggctttcagcctcctcatctgtaagacaggagaaaaccacctgcccaagccatctcagagggctgaagagaaaacaaaatgtaatggaaagtgttttgaaaactgtaaatttctacgcaagtctgaagtcttgtcatattattttgatgatacctaagacgattttctgaaaactgcctcagaataaagagagcgtttagaaaaagaaggaagggtgtgttttttagataaggggttaagactatgtaaagaattattagcataaagttttcccagatgacttctatctacttccattaaatctggtaactaattcattcatgccatttgtgccatgtaccacactagctgctaaagatgcagtgaagaaaatgatattatcaccctggatcacaactatacatggggagacagacacacgattcattatagaacaatgtgactactaatacgcaaaatgctaggaagcaaataggcaggaagatcaggagggatttgtgaatggtttcattgaggaggatatatttgtgttgtgccttaaaggatgtgtagaggttcactagtcctttaaaagaggaaggatcttcaggaagaagggacagtatcagaaaaggcatctatgtctaaaagtgcagagtgggtttggggagcatgaggaataatctggacaggtgaagcacaaggaatttcgcagacacagatggcttcatgacttgctcttctgctaattaactgtgtgattccctagtttattctttgttaaatggagacaaaaagaacttgcagaattgttttgaggaataagtattgtgtaggccattcttgcattgctataaaggaatacctgagactggataatttataaggaaaagaggtttagttggctcacagttctgcaggctgtagagcaagcatggtgccagcctttgctcggcttctgcagaggcctcaggaagcttttactcatggcagaaggtgaagtggcacatcccatcagagcagaaacaagaggttggggtggggggtgaggtgccagacacctttaaacaaccagatcttgcaagaacttactatcatgaggacagcacatgatccacacaaccatgatccaatcacctcccaccaggccccacctccaacaatggtgattacaattcaacatgagatttgagtggaatcccagatccaaaccatatcaagtataaaacagtagtaggcattcaataatcactactagtagtagaaattcaacattctaataatgattgagagtctatctaaatagtgtaaaagaaaaagaaataggtgaaaagtcactggttctcaagccctgaacacatggactggaaacaaacaatacgtgttcaggactacaggtgtgttatggatttcacagctgaaataaatataattattgaagatcagagcatttgaaataacagcattagaaacactgagcactagcatatgcccaaagacttgctattaccacgttttcagcctaccaccagcaggaaatctgactcaacatttacgcatataacagtaagagtctatatgcctttattgcttatttgctcaatccatttattgaactcccattatgttccaggcactggaagtacgatagtgaataaaacagtaaccgtatctgccatcatggtgttattaaatccatacacataataaacagtcatttcaaaaacattttagtttgattagtagggtatgataatgttttggaacactaactttggcatgaaacagagatgtacttgaattctgtcaccaccacttttcagctatgtgacctagggaaagtgtacagtctgttctaggactaaatttctgcatgtgaaaactgaatacttagctcatgtggtttttttgtgaggattaaatgaagcacttcatgggaaatacttagcataatattagcatgtatatagtaagcattccataaatattagctattcattttggatacaattctttctataaagactccacctagacatctcttttgggcactggaacaggctagaaaatttgaatgattattttgtggaaaaacaactgaaaatgttggctaaaatatatgtaattaagtatttctatttgcaaagctttactggcaagaaagaaagaaaaatccttaaaggtcaaaaatgaaggtaaagcaaaaatctagaaaagtaagtacaaaagctagctttcactctggaatcatctataatccctggtgaccttgagcatca

SEQ ID NO: 643 - DNA, 23482 bp, Homo sapiens
ctgttccctactcacacttacatggtattttctgggattctaaggcacattctttttttcctttcctttttttccatttaacatcttaaattggaatgtgtcgcacatttgcggattattataatttgacagcgcctttttcttggcatacttgaaataacggtgcattgtaaaatcagaggtgtctcagatttaatgaaatagaaactaggtaacctctggggaacttatataatttgtccagttcctccaaggatgcaggtggagccaccttgtagtggtggcagattatatgaggggaccctgatgtggttcaaggggacaaccttggattgggcttagattccagctttatggctcgccagctgtgtggccttggcaaagtagagcgacctctctgagcctcgggattttcctcccaccacatatgaatcgtggctccacagttgtcatggctgtgtgcaaggcaacattccctgtttctcttgctgggtatcatctaaggtctgccccgttccatctgggttaagagggaaaatgagggctgggagtgggtcactggccttcccaagggagcagagggaaactggtgttccaagggcttcttgactcagtttataatccttggacattactcttcttccctcgtccttctccccctttgcctgagttttcattttcacatgtgtttccttttagcaattttctttcaaatctctcctctccctttctgtaaagtcttcccacatgtagcctctttgaagctccctggggtgggaaaggggaggagggctctgcctgatggcctggatggcacagacctcagaagcccagtgtgctgtggtccctgcaagcttcagctcaagtccaagttctggtaccatcagcgttgctaactgccattcctgtggctgcagggtcagcctgagtccactccagtgcacagtgttgtccatggggtgctggatgtcgcatcgctgagagcatttggtattctctgtaccctccttgctgcgttaaaatcagacctggttcaaatcccagccctgcgacctttcacgaattacttaacctccttgaacctgtgtattctcatctaaatagtggctgatgcacagaaatacctggcacacaataggtgcttagcagatgcgtgctttccttgttctcaaatgtttaagacccctttgtggacaggcacgatggttcatgcctgtaatcccagcactttgggaggccaacgcgggcggatcacctgaggtcaagagttcgagaccagcctgaccaacatggtgaaaccccatctctactgaaaatacaaaaatcagcccggcgtggtggcaggcgcctgtaatcccagctacctaggaggctgaggcaggagaatcgctggaacccggaaggcagagcctgcagtgagccgagatcatgccactgcactccagcctgggcgacagagcgatactccatctcaaaaacaaaacaaaaaaaaaactgctttgtgcttgtttaggtgttaaggatctcggggagtgccagccagtggcactgctcctgagacagacggaggagttctgggcagggggcagtggcaaaggcacaggggcctgtgtgagcaggatgtgtcaggggccccgtccttcaggatggctgggctgcagtggggtgaggcaggacggagagagaggaggaagagtggtggggtgggcacccagtcggcacctacaggggtgcacatgacaaggctgcacagggtctggctggagcagtacagagggttaggtgtgggctgttcatggaagtcggggctgagttggggaggcaccaggagacagccacatggggatgtctgggtgacagtggcccccaagcaggggctgagtgtgcgctgctggctagagggaggctttaagagcaggtgatggttttaaaccttgttttccttggagatcttctctctgccccctccctcttgagattccaatgaaagccagtagcccaacctcctcagttttgtgtgtagtgtcagagattcgaagccccctctttgatgaggtggtgcttatgccccctgtgcataagaagcagcatgtgctgaggcattggggtgggtaaaggtgcccaggagcctggggtactagggaaggggagaggcagagcatgtcctgaggctgagacctgctggaaggggctttgcgagctgctctcaggagctgggcctggttctgtgggcagtggggagctcacaagctcttagagggggttcccaatggactccctgggagggagagtctccaccccatgagcccctaatgccctctcacctgtccccactgcgagaaagcctgccctggccggaggccctaagctgagctctggccagctatgcttgagtgacaccccccaaccccccatgcaagacagcagcttctggaacacgaagcttgggtagctgggtctagcaaaggccacaggacaaagagagacacctgaactgagcttgctgggaagaccatgggggctatgtgctgatgggaggtaccagaagatggggcagggaggaggagagggttataaaaaccaagggctctggcaggaggccctgcagggttgggaggaggagagtcaccctgctgaccctgacctgcctgctccagaagggcgggtcacgtggagccttggccattggctgtgggtaaacatcggtgctctgctggctgttcaaggcctgagggttctgtggcagaggaggagctgggtgggaacccaccctggctttggaccgtgggtcagctccatccaggcatgctctccttgagttggatagtggcctctctctggaaagttccatgtcacctctttggagggtgctcccctgaaaatgtagcctgacctacccggtggactctacgagaagaaagagctggcctgagccactgttttccctcccaaaccttcactttgagtgaagtgtttttatcatcgctcctcttatcatgatggtaaagtatggagcccccaaagcaagccccacagactcttggttgtgtgagtaattaagccctctcttcaaaaagccacatcttgaaaagctataatttgtagcaaaaaatagctgcccgttccaagaaccaggagagccctttatacgcaccccattcaactgcagcacgttacttcgcttttgagttgagttgctgggacctctggtccatgcttttcttgggggaaccagagatgcagtggctgcatgggaactggagcttccggtaggcatttgggaaatcttttctgagaatttagatgggacgatttaaattagggaactcctgatttgggtttgcatggccccaactttttgtgtgactccaaaggggagtaaagagaaaaactgcaggatacttcaggggaaagtggatgagactctctggacaccattcccccactttttcttttccttcttcctttctttcttctttttttttagatagagtttcactctgtcgccaggctggagtacagtggcacagtctcagctcactgcaacctcctactccctggttcaagcgattctcctgcctccgcctcccgagtagctgggattacaggcacgtgccaccgtgtccagctaatttttgtattttttagtagagatggggtttcaccatgttgaccaggatggtctcaatctcctgacctcgtgatccgcccgtctcggcctcccaaagtgctgggattacaggcatgagccaccgcacctggccacatttccccatctataaggaggaaaatgataattacttgcagggagtttaccacctctgtaaagcacagagcagactggccacatggtaggcgccctagtatgtcaactttgttctctttctctgagttgtggctccactagctatttgtagacaggagatctttgtggcttcaggtaggtgatgggggactgaaagctaagaggaaaagcctcccctgacctgcagcttctctttgagctggcatgcctggaattcttggggctggctgctgggtttgttttccagatgtggaagcaatttaagttctgttttcttaatccccaacagtttgcctccgaagtccacattctcatttgaaaatcaaggccgttggctctgtttgcagggcagagggtaggctagatagcctcttcaaaccctttttgtttaggaaatgggcttactggggcactcagatctgggacccagggcattcttgggacagtcacaccccatccaggacttggttaaaaggtgagttcactttctctgtgggttttccttggagatgattcactgagctaaattcagctgcaccttggttacaaaccagctctagaccgctgtggagtggcgggggtggggctcgggtttgggccatgtcacaggccagctggcgtccctctgagcagggtgcccacgtgtcccgggggcagtagcggccctccttcccacactgaccacaacagagggaggaaaatgctccagatgtcaggtagccagaaatactgtctggcacggagaaactggtaatatcttgttcagttactgagcgctgctggtcacagaggcagcctgacccaggataaaaggctccttgtgtgagggcctgtggctccagggctaactgctgatttattctcttgtaaagcaatcgctgtgtaggtaaaataccttttacatttgtcttataactatactaaatacagttttgggcaaacaaaaattgcctttgcaattctaacgtctctgaactgtgcatatgcttctctgaaattgaaatagaatacttatactactgagagaatgcacaagaaaatggaagtggctgggcatggtggctcatgcctgtaatcccagcactttgggaggctgaggcgggcagatcacgaggtcaagagatcgagaccatcctggccaacatggtgaaaccccgtctctactaaaaatacaaaaattagctgggtgtgatggcacgcgcctgtagtcccagctactcaggaggctgaggcaggagagtcgcttgaactcgggaggcagaggttgcaatgagccgagatcgtgccactgcactccagcctggtgacagagtgagactccatctcaaaaaaaaaaaaaagaaaatggaaataacttacttagattggcatatagtgtttatagaatgccatcctgataatcatagattcaccaagctttgatttcaacaaaatatcatctcttaagaagtagcagtatttcaaactaatcgtgaaagagaataagagaatacaacttttttttttttttaggacagaccaaaaataaatccctgagtctcttgagtaggttctggaaatccagttacagatgctccttgatggggttacgtcctgataaacccattgtatattggaagtatcataagttaaaaaaaaaaaaagaaaaaaatgcgtttaatacatctcacctaccaaacaccatagcttagcctaggctaccttaaatgtgcccaaacacttactttagcctacagttgggcaaaatcatctaacacagagcttgttttacaataaagtgttttatgtcccacgcaatttattttttgttgttgttgttttgtttgatttggtttggtttggtttttctttgagatggagtctggctctgttgcccaggatggagtgcagtggcgcgatctcggctcactgcaagctccgccttccgggttcacgccattctcctgcctcagcctcccaagtagctgggactacaggcgcccgccaccacgcccagctaattttttgtatttttagtagagatggggtttcaccatggtctcaatctcctgacctcgtgatccgcccgcctcggcctcccaaagtgctgggtgtaatccaccgcacccagcccatcccacgcaatttattaagtactatgctgaaagtgaaagacaatgctcttatgggtacttgaagtatgacttctactgactgtggatcactttgcaccatcatacagttgaaaaatcaaagtgagcccgggcatagtggctcacggtggcctgtaatcccagcacgttgggaggccaaggtggctggctgcatcacttgaggccaggagtttgagactagcctggacaacatgccaaaaccccatctgtactgaaaatacaaaaattagccaggcgtggtggtgggcacctgtaatcccagctatttgggaggctgaggcaggagaatcacttgaacccaggaggggggtgttgcagtgagctgagatggtgccatcgcactctggcctggttgacagagcgataccttgtctcaaaaaaaaaaaaaattgtaagtcaaaccattgtaagttgaggaccatctgtagttctctttaaaggttgaattggctgggcgaggtggctcacacctgtaatcctagcactttgggaagctgaggtaggtagatcacttgaggtcaggagttcaagaccagcctggccaatatggtgaaaccccatctctactaaaaatacaaaaattagctgggcgtgctggtgggcacctgtaatcccagctacttgggaggctgaggcaggagaattgcttgaacccaagagacagaggttgcagtgagctgagattgtgccactgtactccagcctgggtgacagagcaagactgtatctcaaaaaataaaaaaataaaggttgaattgaattgacctttaaaaagttctcttttgttatcagggtgagaaggtgggcgaaaaatccagactgagcttgggttggggtttccatgaagccttcctaggggaggagaagggatattggtatattggtctattggtctgctacggctgtcatagcaaaggaccacagactgcgtggcgtaaacaaccaaagtgtgttttatcacaattctggaggctgaagtctagcatcaaggtgtcagcaggcttggtttcttctgagtcctctctccttggcttgcagacagccatcttctccctgtgtcgtcacatggtctttcctttgcgtgtgtcctaatctcctcttataaggacaccagtcacattgcgttagggcccacccattaggacttcaatttaaatgaattacctctttattattattattattattttgttgtttgttttaagacagagtcttgctctgttgcccaggctggagtgcagtggcactatctcggctcactgcaacctccacctcccaggttcaagtgattctcctgcctcagcctcccgagtagctgggactacaggcatgtgccaccacgcctggctaatttttgtatttttagtagagactggatttcaacatgttggccaggctagtctcgaactcctgacctcaagtgatccacccacctcgacctcccaaagtgctgggattgtaggtgtgagcctgcagttcagcccggcctgaattacctctttaaagactatctacaaatacagtcacattctgaagtactagggattaggacttcaatatatgaattttagagggaacaggattcagcccatagcagaaaagggtcttgggaacctccttcaagggaagggggaagaggaagaggagggtgggcaaagcctggcagagtagaggggaggcagttctgctttcaggcaaaggcccatgggtgagggaccccctggggatggctcttgaccacctgctctatttggaaacatttctaggactgttatgactgtgaatggtcttttagaggccggatcattcttatgacctcagccatccattgccgcttgatctgatcatttgaaaccaagactgctcgtcgttctgttctcatttcatccttgaagctcatgttggtctgttcgggctccagtttctgtggactctacccgctaggatagtattctttcaggatggcttcactttttcatattcttttaagtagagccagacctgtcaggaaaaagcgaataaaccgatcaaaaaatcagcaaaagatccgaatagacatttctgttatatgtaatttatataaatggaaaacaggcatatgaaaggtgctcaacatcattgatcatcagagaaatgcaaatgaaaactataatgagatatcatcccatcctagttaaaataccttttatccaaaagacaggcaataacacttttccttcactagttcagcaaatttggggcaggctattttttcatgtttccatataatgtttactactacttcttttttttttttttttgagacattgtctcgctctgtcacccaggctggagtgcagtggcgcgacctcggctcactgcaagctctgcctcctgggttcacgccattcccctgccacagcctcccgagtagctggaactacaggcacccaccaccacgcccggctaatttttttgtatttttagtagagatggggtttcactgtgttagccaggatggtcttgaactcctgacctcatgatccgcttgcctcggcctctcaaagtgctgggattacaggtgcccgccaccacgcccggctaatttttttgtatttttggtagagacagggtttcgccatgttggccaggatggtcttgaactcctgacctcatgataagcgctcgcctcggtctcccaaagtgctgggattacaggcgtgagccaccgtgcctgtcctgtaactttcaaatgaaccaagtttcttttcaaatgagccatttgaaaagaaattagactaaatattatcaaaactaaggacattttccttcacaactatatgccattaacacacctgacaaaattaagcataattccctaatatcacccaatatctactccagattccatcctccttgtttatcctcaaaaggtcttttacagctggtggtggtttgtttgtttgatctgggatctaatcaaggataatattcggtttctatgtctctcagttaatctagaacagtggtttgcaaagtgtggtcctgggacaagtggcatccgcatcacccgagaacttgttagaaatgcgttttcttccagcctgcctcaacctttagaaatgcatcttccctgtggtgatgtgtaacttctatcccatttttccgtttggtagaagttagatcctaaggcttgatttgaattgagttaaatacttagttaagcccacactataggtgatgctgtgtacctcttaggcatcgcgttgggaggccagcgcctggttctttccaattagtgatgctaaatttgatctctgcattaaagggacagtagtctgtgttctccctggtagaggtatgtggggtgctttggtgttttgcagcaatctgtagggtgattcttcggtattgtgcaagtatctagtttttcattagcctttaatctactggtgttattctgcagttgttgagtgtagtgttctgtatgtatcagtctggagtttgtgttgttctggtcttctgtgtcctctctaattctcttgtttgcttattccatcagtaataataataatatataataattattatatattaatatataattattatataatatataataattattataacatataataataattataatatataatatataattattatattatatataataattatatattatatataattattatatattatatataataataattataatatataataatatataataataattatatattatataataataattatatataatatataattatataataataattatatataatatataataattatataatacataattattataatatataataattatatataatatattaataatattattattactattattaaagacagaatcttgagctctgtcacccaggtgcaatcatagctcactgtatcctcgaactcgtggcctcaagcaatcctttggcctcagcctcccgagtagctgagattacaggcatgcaccacctggctattcttttttactttttttttttttttgtagagatggagtctcattatgtttcccaggctggcctggagctcctggccacctgccttggcctcccaaagtgctggcattacaggtgtgagccacgttcagcatgttccatcagtttctgagagaggtgaattaacagctcccacttcccattctgttaagttttgctttatgttttgagactgttagatgcatagatataaaagtgttacatcttgttaaatttcaattgtgtttcttgtaagtggtatgtagttgtttttaatttactctgacaatattgatcttttaataggattatttactcagttttctttaaaagtattactgatgtggtagagttttaatcctacataatctttaagtttttaattgacatacaattgtacatatttagagagtacagtctgatgttttgatacacatgtgtattgtggaatgatcaaatcagggtcattagcaaaaccatcacttcaaacacttgtcatttctttgtggtgagaacattcaaaatgctatcttctagctatttttaaatacacattgttgttaattgtagtaaccttactgtgcaatagaacaccaggacttagtcctcccatctgactatagcttcgtgcctgttgaccaacctttccccgtcctcccttctcctaccctctccagcctctggtaaccaccattctactttctacttctatgggataacttctttagattctacataggagtgagatcatgctgtttgtccttctctacttggcttatttcacttaacacaatgttctgtaggttcatccatgtcacaaatgacaggattttattcttttttatggctgaatactattccattgtgtatatatacaccccattttaaaaatgcattcatctgttaatggatacttagttgactccatattttggctattgtgaattgtgcttcaataaatgtgggaatgcagatctctctttgacatactgatttcttttcttttgtttgtatacctagtagatgaattgttggatcatatgatagttttaaattctttgaggaacctccataccgttgtccataatgattgttctattaatacttacagtcccaaccgggcacagtggctcacagctgtaatcccagcactgtgggaggccgaggtgggcggatcatgaggtcaggagtttgagaccagtctggccaatatggtgaaaccctttctctactaaagatacaaaaaattagccaggcgtggtggcatgtgcctgtaatcccagctactcgggaggctgaggcaggagaatcgcttgattccgggaggtggaggttgcagtgagccaagatcgtgctattgcactccagcctgggcgacagggtgagactccatctcaaaaaaagaaaaaaaaggttacagtcccattaacagtgtataagagttcccttttctccacatccttgccagcatttgttattttctgtctctttgatgatagccattcttattagggtgaggtggtatctcattgtggttttgatttgtgtttccctgatgattagtgatgttgaacattttttcatatacctcttggccatttgtgtgttgtctttggagaaacacctattcagatcttttgcccatttttaaattgaattatttgtttttttgctattgagttgtttgagttccttatgtattctggctatcagtcatctgtccttttggatgattcaagcatttttttattccttcatttctctcatctattattattattactattattttaagatatagggtctcaccatgttgcccaggtaggccttgaactcctaggttcaagcagtcctcctgcctcagcctcccaaatagttggggatacagccatgcactgccatgcctggcttagatttttagtaatatgttttgttttattttattttattttattttaactaatttatttttagacagggtctcactcccgttgcccaggctggagtgcagtggcaccatcacagcctcgacttcctgggctcaggtgattctctatcctcagcctctcaagtagttgggacaacaggcatgcgccaccacacctggctaactttttgtattttttgtagagatagggtttcaccatgtttcctatgctagtttcaaactcctgggctcaagtgatccagccacttcagcctcccaaagtgctgggattacaggtgtgagccactgtgcccggcccgtttttaactcccaacctttgacatgctcacttgttattggaacggaagtggcacagtggggagagaggagtgagagcgtctccccacagtggatggctcagctgttcgggatgtttccagtgggatcacaccatggtccagggtctggtctgcatcctaatgggcttgaaaaccagatcttactggcttttcccacaccccacaacttgagtccactcatgctcactgattgtccctaaatggacctgcagagccagtggatccccttgtggtgagaaatgcactcacatgagcttgggcagcccttctctcctgtctgtcagcaggcttctgggagtgggtgctacgtgaacttggacacaggggccaagggctggacaggtgtggaatgttgagccaggccccaccgcctttggggcaggctggatgtgctggccagccagacctgacacctctggccagtgcctgggtgcacgcggcccgggtcggcctcagaccctccctcttggtgcttcccaggagaccactcgcttagcccctccctgaggacaggctctgtctttagatcccttagtacttcagtccctctgtcagcctcaggaaatgtgtgcatctctcttagttgagctcccaggaggttatctgacatctctcatttctgagtctttctgggagcctcagcacacaccccgcttcctctctgtgggctcctctgacgctgccttatcagcagtgtgtgtgttggggtgaggttgtgagatcggagagagagacagctcaagagttgtgatgaaaacactgaaagaaaggcagtgtgggcttcagcagcccttcctcggtgatgtttgtgcagcagcagaacttgttgagtgaccgcctttgctttatgtaaatgtcatgagttctggagaaacacaagcatggctttcgctttcttttctgttcagcaccaacctgaggttccacagccagtgtgtgccagatccagaactgaaccaaatctgcccaagagcctcagtctccacatcttcaagcccaggagtttgaaaccagcacaggaaacgtggtgaaaccctgtctctacaaaaaatctgtaaaatagggtgatttattacctccctctgggggtgatgcaagaagcctgcttgcttctcatgtgaaatgaatgagcacctggggaaccccagttgtcccggttgcccccgctcctggggtctgcaggcccaccttaggatggaagtggagcgcagcaaccaggtgtctacacaagatccactcctagaagctgcagggcgggagcagtgggccctgctgaggggtggtcttgagctcctggccacaccctttctggggtgagtttcaggaggtggatccggggcccccggctgggagaagagagtctggaagctgccctgccttggctgccatcccctgggagggagtttagctggaggaatggggcactgggtccctccctgacaccccggggcctctgagccactctggggatggaacgtagcagtgcagcatttcttcctgatcagagcgggaagctctgggctgcagagctttgatctcacagtatgtggtcagtccccggggctggctgaggtgtgggatgatccctcgtgacctggcgacctggtgctcccatgcttacccctggctctgttggggtgagccgaggcctcatgtctgagctgaggttgcttgttgttcagaaggcaaggccgaggcactgcctctgggtggatgcttgaaccccctttatcccacccttgccttggctggtgcctgggcaactctctgttgaaccaaaacctcttatcagcaactgataagtacccagccttgcatctgcagagcaaggcctgacccagagccagggttggcagctgcagcaggagtccgttacagccaagattgcgtaccagtctctgcggccaccaccttttcatgatgagagcagccaagccacagtggggtgtggaagaccccagccctagcaatcacatcccttccctgtggacctggggacattggcacctatgagttagctcagtaagctgaatttcctgctgcccataggaaggaccccgtgagaccttgacctggcccatctcgttccagagctgttggttggctgggagtggggtgagagattcatcacaggcctagccctggcaaccgctggactcccctacactaggcttagtgtgtgtccacccccaccgcacacatgcacaccttcccagcggcagcgctgcacgtgtgcctgctggtgccttgctgcaagggaagtgggcatgtgcccgcccaagctatttttaccctgccttgtccccacagagctgttctttggctctgagttagtgcctggggaatgaggccgttgccagggctgggggtggatgagctggaacctcggagcttcttggactcccttccccaggcagcatctcatcttaatgcttactaaagggtgtgactcgtgtgcagggcgaccttccataagagtgggcaggagaggaccctggtggggagaaagaggcactgatgtttggagggcaggctctggaacctgcaggtctggcttcctgcagccaaaaaaacccagccgagctgcagcccagtgagccacggtgggtagagggagaggtcccaggggctggatgggagccaggaggccaggaggtaccctggattgttttccttcaacacaatgacgacaatagtagttcagttttggggtgtggtggtgtgtacctgtagtcctagctgcttgggaggctgagctgggaggatcacttgagtcctgggagtttgaagctgcagtgagctgtgattgcgccactgcattccaagggtttttttgtttttgttgttgtttttgtgtttttgttttgttttgttttgttttctgagcactttctgtgtgtgctaagaccataaagtgcttaggatgtgtagcagctcatttaatcctaatcacagttaactccattttatagatggggaaactaaggcactgagcagttcagtaaccctgaagctgcagagctcatgaatggtgaatggtggagcagggctctggcctggccgtctactccagagcttgtccttaacgccaccccgcgcctccttttgccgtgtgttccgcgccctcatgacacaaggcattgtcctagttccctgtggcagcctgccaggcaggtggttccctccccgtgtttacatcaggcccagaaattaaacagctgatccagcatcagacagtcaggcagtgaccacaccagagtcggcacccaggtctcagggtcctgtggctgtgctgttcccagctcatcatactgcagtacagtatggttccaccacctgccatgtgctctctacagtgctaaccactggggttctgacatgtaaatccccatagctacccacttagggtccttgctctcacagggaaggtggacatgtggtcacttggggtccatgtactctgtgtgtcagctcagggaaacgcagggtgctggcgtgtgcctgtgaggtggctccccatgggggaggtggggagggagaggaccagatgctgcatccgctctgagagtgtggacagtgtggcattgttggccactctgaggctgggacggcccccacgtgtattgatacttggccttttcagcagccctgaattcatcccttgccaacttcctacaaaagaaggggtgacttggggcctgctggcaggcgaacacggctctcaagactggagagggccccacggcaggctgtgtgcctctaggttcccactccctgctggggacagggtgggacagtgggacagcgaggtaggggtgcaggggatgcagacctgccctgccagagtggctggctggatcctgttctccagctctctccagaatgccctggcctcaggtaattcctcagcttggcttctctgaggagggtgggcgtccctcctggctgctcgtctgtccaggacattgctggctgaccagccggggacccatggctgtaggaatagctcaccctctgttgcctgtagcccctcgtgaggccaggtcagaatttacggctcctaccgtgaccgactctccggtgtaaattgtcacgtgtggccccctagagctgccactgaggtggagttgactggccccattctgtaggtgaggagccaggtgctcacaaaggtggtcacttgtccaaggtcacatggcttgtaagtggctgggccagcagggccggaaacccagactgctaggccccagagctgagccctcacccaagcccacccccaggggcctcctggggcttctggaggaacacgctgctgcatccgctctctcccttcaccccggggtccgctggcaggtggaagaaagcctggggtggtgtggccatgtaccagccaagcctgtgggcctatggtggctggccctgtgtcccagggtacagggagctgtgagctcagggctggctctgggtcttgagggacagagccctggcaagtcagactgtgccagagacgatgcccggtgctgcctcctgaggataccacactgtcccttccccaaaggcccccaaaagagcagacacagcctttctgtgcaaaccctgggaacaccaggccaagctccaggcctggacatgtgtagggtccctgggtggtgactggacggccgtgtgtggactcctttttcacacagcaggcgggaatgggcaggaaaccggggctctgagaggcagtcttggaagctgccctgggcacagaccttacttgctgaccccggccacctagaaacatgagctctggggaggccctgtccctgccccaccactcctgccagccctccagagccaggcttgggtgggcgcctctgtggtgaggatgtagaccgtgcagctggggtgagcgggcagctctctgggcatcctgacgagcatagtgcggtgaggtggggtgatggtatcctctcccatgacccccagtctacttggaagtatgctcaacagggggctccgcgtgattcttacctgcaggcagcctggccggagaggaacccaccgcctccagaagtctgtgacccccaggccatctggaaaccttatgagggcaatgtttttattatggccaagttcttccttttcctctgcaactttatctaaaaaacatacaaaagggaaattggccaagaagagtcctagtatgcttgactccgagttctcccagcccatgaatggtggctcaaggagagagaagaggctgcgttctggcaccttccagcatctcccctccaggccggcgggagaaggagcaagggcttccaccagacccttccccagagggccggggaaacaagagctggggctggggactttggccctcagggaggagcaagggtgaccatggcaaataccaaaccaaggggatcttgggacaggcataaaccagtactgtcctgggctaaccaaggcgtgcagtaaactgtctttattatatttgaatttagggggcaaactactagaaatggttttaaagttataattaaaatttccgattgccttggacaaacaactgtgggttgaatgaaaaagtattaatgttgggaatagccatttttaagagaaaaagctggagagagtgtgtgcgcatgtgtggccaggcaggtgaggacttggtgtgtcagccgggtgtcaggtccctgcaggccctctgtgaactgcaaggttccagggcagccactctcccactctgagcctcatcttccccaggtgtcagacggagctgatgaatcccagatctctgccctgtctaccccaggcagctcgcacggggctgttgtgagggatggggtgtgtgagacaggcgaggagcttgctgaagggctgggcagatgtggactctgcttagtccaaggctgaaagcctgcccgaggaggtggtggtcttctttggagggtgggaacctggtgcccctgcttctgccctgcctgtgcctgagccaagccatttgaggctgctctctccacccggtcaggggcttgggccagctgctgggagtatcaggacgctgctgtagatgttgggtgagagggcccggtggttccacctgcatgtcatgagccaggtgttagtggggcagtgcccggcacacactcggcctctgtgtcctcgtgtcagtggccagaggccacgtcagacacctgaggagcaaggacgctgatctgcactgggccctctgcctgcctctgggagctggtgggccatagcctccccaggatgtggctgtagggggaaggtgggtgttggggaaacagaatcatgtccggacccggctgtaaactcccacatggccccaggcaagacccttcacctacagaaaggggaaaagaggctcagctcatcgggctgcggtgaagtccagaagaaacaccattgccaagttgctgagctctcacatgagccacagggcgggcattcccagcaagggggaactctcgctacccgtgtggccaggaaggtgaaaagtttgcagttcttcctggccaggtgaaagaacagaccaggcgcattgtcctctgagagccccaggtctcttctggtctccctcctgccttgtttctcttaggtgtccccgcactaacctgcagtgtcctgtgagggcgttaagtggatggacgtggaagttgctgcgttaggcggcatgctaaggagtcataattagtcacatgtccctataaaatgtgctctccttgttgtcaccatgaggtttgaaaatccacaaagtgtgggaggtgtcaaggataaatggaatcaagtgtgtggatgcaaaggcaggcggggtggggggccctgccctgccctgccctgccctctggctggaggacttctgatgcgctactctttgagcctctgtttccccatcagtaaaatggggataatgatcactgccctgaagagctgtcatgaagcacaggtgggataatatgtgaatgcccagctcggtctctggaacctaatggctgctcagtgatgctggtttccttttgtttctactgggatgcagcttcaggcttggggatgaagagcttgcttagggcacaagatgtgataggttgggagccatgtgaccagattaatgacatgtgggtggaaggggccctgggaaccctggggggattctcattacacaacctcagtctccacagtctctgctgttggcgtgcccggctcgctggtgtacgtgttattggtccatctggtgctcagcctatcacagcacaggcaggaaccaggctcatgataatattgccatctatttttagcccaggggtctcctggtggggacggacccccaggagggctgccagctcactggtagcagcagacggctgcacatgtctgggcaggcacatccaggcctgtcgctgagcagcttcttcagctgtctgagactccaggaggcttttcacagcctgtttctgttgcccttcttgtagtctcgggactgcagggtcctttaatagggtgccctgccagccctggctgaggagcacaccaaagaaccttgggaacaggttgacatctccaatgggtcaggtagaagcggtgccacctgagaagtacctacttcctcagaggtgaagtggccccagtaagtgatttacagagagctgcccctcggtctagggccaactctgaaccaggccgaagctcttctatctgatgatttaacaaaaggtgccagcatgtctttatcacacactgtcattatgctgggccccagacccagcacaagcaacgctcagaagtgaggcctggcattcttgctcccagcaaggctgtggcagggcccagacaggcagttgcctcctgggctgggcatcacatcttctggccagggtttattcattgaggtcctactgtgtgtcagatgcgaacgtgaaatacctcatttaatcagcacagtgatcctgtaagattccattgccattcctgatttacagaagacaactgaggttcagaggtgttccatgatgtgcacagggtcatgtagggtggatcccaagttgtgcagctttcactgcaccatgtggcagcagactctactagatcagggttgttggtcctaaaagctgttcagtgtgactgtgcccttacaccgtgcaccaagaagccttctagaagccgtttggcttcctctgacagacttttgtggtggttttaccagtggagggtgtccaggttcttagcgtcttgaacaaaaattggacaaaatgcacaaacaaaacaaagaatgaagcaacaaaaacagagatttattttattttattttttgagactcagtcttgctctgtcacccaggccgaactgcagtggcgctatcttggctcaccgcaagctccgcctcctaggttcacgccattctcctgcctcagcctcccgagtagctgggactacaggcatgcgccacctcgcccagctaatttttgtatttttagtagagacggggtttcaccgtattagccagggtgatcttgatctcctgacctcgtgatctgcccgccttggcctcccaagtgctgggattacaggcgtgagccaccgtgcctagagatttattgaaaacgaaagtacactccacgggatgggagcaggcccaagcataggggatcaagaacctggttgcagaattttctggggtttaaataccatctagaggtttcccattggttacttggtgtacaccctatgtaaatgaagtagtggcccacagtcagtttgattggttgcaggaggggaccaatcagaggccaaagtgaagttacaaagttacaccctatgcaaacatctgattggttgcagaaagcaatcagaaagcaaccaatcagagactaaagtgaagttacaaagtgatattcctatgcaaattaaaacttagcctgtgaccagcctgattggttgcaggaggggaccaatcagagatactctcagtttttcatctgccaggcagaaaaggttggggggcgaggaggcggtgcgggggggggggcggtggggggggcgggggggaaggggatgcaaagggagtagctacttgggctcggaaaattggggttttccttttgatttagctctaggaagtcagtgtgaatcagccttatgttccctgcctccagaccctattctgcctcagtgggggctctgatgtgccaaccagggtgccctgaataaagtggctagcctgactgtggcccttcttcgtggatggctgttcctgggagttctagctcctcactagatgctcatgagtcagccagtatgagaggtccctgggactaatcacctgccaggtgttcccacgcttagggttcgggatctgggcctcctgtacccaatccctgctgttttggcctggctgatgcccttgtggtctgattggaacactgagccctgggaagctggcctcacttatcttgtctctgctctctctttcccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtgagttaaaaccacctgaagctccatatttgccctctcagcccagaaatgtggttcttggaaagtgtctccaggaagtaaatttgaaacatgctcaaaatttgtatcagaggcattagtgtcatgggtattctgaatagcacaagattctaagcagactaaatgcttaacagtaagggatagttttggaattttaggcagctgtgcaaagtcaagtttttaaatttaattttactttattttcagtcctagctgtgcaggcaaagggagttttaaatgactagttaataatatgagatatatgatctcaattagttttaaaaagcaggttgtggccaggcatggtggctcacacctataaccccaggactttgggaggctgaggcaggaggatcgcttgagcccaggagtttaaggttacagtgagctgtgatcacatcactgcactccagcctggcaacagatcaagaccctgtctcaaaaaaaaaaaaaaaaaaaaagggcaggttacaaagatgtccatgagatcagctttgttaaaaacacaaacatatgccaggcaagtggcatgtgcctgtagtcccagatacttgggaggctgaggcaggaggatcacttaagcccaggacttctgggctctagtgcactatgccgatcggatgtctgcactaagttcagcatcagtatggtgacctcccgggaatgggtcaccaccaggttgcctaaggagggatgaactggcccaggtcagaaacagagcaggtcaaaactcgagtgttgatcagtagtaggatcacacctgtgaatagccactgcactccagcctgggcaacatagcaagaccccatctctaaaaaaaccaaaaaacaacacacagacatatgtgttaggaaatgcctagaaaaaaattaatctggaaaattaagcagttatttctgtatggtgggatgattttttttgttgttgttgttgttgagacagactctcactctgtcaccaggctggagtgcagtggcatgatctcacctcactgcagcctccgcctcccgggttcaagcgattctcctgcctcagcctcccgagtagctgggactacaggcgcgtgccaccatgtccagctaagttttgtctttttttttttttttttttttttttgagacggagtctcgctctgtcgcccaggctggagtgcagtggtgcaatctcagctcactgcaacctccacctcccgggttcatgccattctcctgcctcagcctcccaagtagctgggactataggtgcccaccaccacgcctggctaattttttgtatttttagtagagatggggtttcaccatgttggccaggatggtcttgatctcctgacctcgtgatccacctgcctcggcctcccaaagtgctgggattacaggtgtgagccaccgcacctggccagttgatcattttaattacttcccatctactctgctatattttctatattgagcatgta

SEQ ID NO: 644 - DNA, 31059 bp, Homo sapiens
agggaagaaaggtagaagtcattatgaatttattatttacacgattgttaaagtacacaaatacagtggcgatacaaacgcacagctcggagactggccgtcagtgcacagctgacacgacgtcctacctacgtctcctgcacggggcgacggggactagatactgggcaaggactgtcacaagcactccgaagacgcgacccggcgaggctcgggctggaacccgggcgcagagctgcctcgcacaaacgttctgggcactacatcgggaccacagatatttacaaagcaagcttgcgccacttcaggccacagcgcgacgtctctccgggtgggggacgtctaccttcaagaaggggtccagcaacaaagaaaatctcttaactcggctctgacccaccccaacctccctctgtacttcaacacacagctcccacccgctcaaggccccgtactccaaaacgcttacacagtaaccagcctaggattgagaaagcatccatgggctcaggcagacggccagccagctggtgggggggtgaacaactgtgttctgggacgccagccagttatggcatccggggaactctggggaggagaagggagaaccaaggtgcacaccttcgaagccctagagtccaaagggaacatcgtccatcgtgatggggtccagccgaagtgcccacgaacacagactgccctgcgcattggggttgggagcacatggccactggctaccgcccaagtgctgcggagtgagaggcgagaaggcatcctgggaacctcagggcacagcagcatggagcctggggcagcaccagctcacggaggccacctgccttctggtgggactcggccccacgcacgctgcttcacttctgaccaacagacacgcgcccaacagaaggtcacagcgcagactctactttctggccgtgaaggttctgggtccggttgggagagtcacctgctccttggcacctcagggtgggtccttctggcctgccggcttttctgagctagtcttggcacgtggcaaggacagccccgctcctggttttaagcacaggcattcatacagacggagtgccaatccgcacaggagcattgagtgctgagaaaatggactgagtgcaaaggcagcaaggcaacaaacactacagtaaccacctctcggttcacagtcctctcccaagggaccagaaacgcatcttccaccttgaatcctgggactcccaattgtcctgctagggtctcaaagcctctgcttccaagctctcagctgcctgcccacctcctggggaagaagcgcgcagtgctttgcctggtaacacccactgcacccctgccccgcggcagcctgcggtccctaactgctctccgagggcctcaagagttcctgacagcaggcatgtcaattacgggaggagggagggtgagacgccaaaatcaggttgaagaggtcccaccacacacgggcacacacacacaccacggacttttgatgagaaatctcctctccaaagcggacaataaaacactgcaaaacaaacacagcacacacccttgagatccacctgcaccttctccctgcccgactccacctcatacactaactccaagccagcctgtctcagaattccttagtcaacattttttttgtaagactgcaaaaacagacaagaaacaataaaaagacagattttctttacacagatttaagccaataatttttagcaaaatgatacaaaactgtcttaaccaagtagaagattggtagttacagtggaatcgtcagggagtacagggcggccaccactggagggagctgaggccctggaaaaggagtctgattctctgcaattctctctctgcttttcttcccagccccgttacaaccgagttcacgtggggggccgcagtgcagccccagcggtggcagctcttggagtctgtccgtttagtatgtttcccccacgagcgtcgctgggtgagtggcctggagagctcccggtgttaacatttcgatcctagaccgggggacgtgtcactagtaaagccattggtaacagagtagatcagccatgcattgtctgcccttcacagcaataaggagagttctcatcggtgcacgacagactgaagaccactggaagccacccgaccaggaatctgtcggagccaaagcacaggagaaggtcagcatggggctgggggagccggccaggcagataccacagtgacggtgctgggcagggaggggacgcaccgccaccgcctagccccagtctagacgcctgcgtcccccgccacgcacaggggcctctgtggctgggacacgtgctcagcagaacgagtgacaggaagacgggaaggaggaagaggcatgcaagcaaggtgcccgcggagccgggctcggcagggtcgaaggatccgagtggagcggagacgggtgctcctgcctcccttcctggaaaggaacctggtgtttgaaaatgggtacccctctcagggaagacatgaaaagcagttcctgtcaacacatttccagagtgtgcacagtgtgaaaactgcagcgggtctcccagcggcacagacccgacagaagcgcaagcccctgctggaaggagccgccgagcgcgcgtggccgccgaggagggagcacagcgtggacgccggccatgcaccgacggcggggagtgagtgggctgcggctggaggagttaatacagacgaagctgcgtggacaagacggctgggcagagaccaagtgtgaaaagaaacacaaaacaaggacagagataaatgagacaggaagagagaggcgactagaaaagctggcatggcagagactgcccagagtgtggcgcagcaagagcttaggagcccccaacaccaagcgtggagccacccagctgagcaggacacagacgcccctccaggcacggccgaccgcagacaaggcaactcaagtgctcggggcacccgccttgccactcctgcctcacgggtgggcacccaggacaggaggagagcaacggcacacggaacgcagtcacggggaggccacaggccaacaggatggtctcctggggtcactctgttccaaagctctctgtggacagcctccccccaagactgggcagcggactgccgccgctctgcaccccacaagaagaacagagcagaagaagcctcactctacctccagcacctggcatgcaagcccagcccacctgcaagctcccatgggtggggcatggtggctcccacccacctggcgctgctgcctggcgcccgccacgcgcacactcacccagtgctgccttccgatgggagacgagcagctacttgccgtggtgttcgaaaggaatgctattctgaggtggggaaaagacagctgttggtaagcgtcccgctggccccctgactacctgtgtcggctccatgtccagatgggcatccttgcctcaaccaggtccacagaccgacaggtgccacctgggggagcccaggcacagagcacagcctcacttgcctctcaggacgggcctctggatgagagtggtgcccactcctcttctggaatcacttgctcttaaggccaacaatggcatgggacaggccctcctgagtcttctcaagcactaagaaaacctgatcccagcaggatggcaggtgctgggcagccccacaactgggtctcagggcacagcctgaaggcaggggagacgcacatcctcgccggtacgacgacagggctcaggcctagtcctgggcaggagttgatcaaagcgagtcatcgactgttggaatgacaaggccttcttctcaccaagtaaaaaccccaaacagactcagcaactagatggcctttagggcccaggctactgtagccaaagagccctggccgaacaccaacagcccgaaaagagagggggcgaagagggaacagacccaggcggagtccgggctggggcggggccctacaactatgggggcctctgtgacctacaggcaggctgccacgtggtcttccacccatccacacccagccacggccagcaagccctgggagaccttcctgctgcctcctcccatctccacagggcgcaaggtctcctgagaggagcagaaagaacagggaagagcgacggcccgaggaggaagactggccggggatgagtcactgcccacggtgactgtgtctccagctcacccgagcaaacaggtgaggcgctcagagcaattgagcctcctgtattcccccttgggattcaaaacgggagctgctgctcacagccaccacgtgtgctggtgctggcagagtctggcaggaaggacacacggccaaagccttcctgtgagatggtgacaaaggagggggcccgccctggaggtggggagccctcaacatgcctctcaggaaggccccccagggtgtccaggagcagaggccaagaggcttcttttggagagaacacacccccaaaccagctctctctggagactcctccctgctgttagagcccacgttgtatttcctcatatggaaaacgagggcctaagagccagctgcgggttcctgccacagctcaccatggaaggagacactgctcacggccaccttgggggctggtggctacaacagccacacccaggtgccgccaaggccgtgtaccgagaaaaggcagctggactcagggctgtggctactcagcacgctcaggacaccttcactgcccacaaagatcccaaaccactggacactttactttctttaaaagaaacaaaaagcactcaggccccttccctagtctttgtcagccaagcgctggggcgaggctgtccaagtccggtcagcacccagcatggggagcactctgggctcctgtaccatggttcaggggctacagagccagccgcacatcaagacacgagggcacgggcagaccctcccgggaactgctcacaggaactgatgcgcaagtgccaggctcgtggaaagaagccagttaaaccctttctgtgctgtgtctggaggtgacagcagggttgtgtgcacgtaagggacccattctcgtgacgcagcccagacccctcgagcccaattcatataaccacaaagtcaaaataaccacgaagccaaaatccctgcatctttggtctctttgggaagaagttatacaaaaaggtctgtttctagtgaaattattagtgaattagaaacgtgcagtaaaaccccaatcattaaaagacggcaagtggtcaagagtgctccccactccggcatgttcctggctagccagctacacccagccccgctcacggcagcaggcctggctccatcctgtgatcccaacaaacacctccccacaagcccagagccaggctccagggcatttctgaactgagttcctgctcatccggaagacccgtgggggatctgggcaccccccaggatgcctgctggtgaaacagccctgccccactaaccctgcccctgttggcgaacaacccagaaaactatttgaagaaatataatggatccatatggagaaagctgttctagttcaaagagcacgttagcaaacgcaaaagacaacaaaagccagagcgaggagaggagagaccgctgcaggatgctgaagaggcggtggccgtggctaggcctgggctgcgcaacagggtacttctcgtccaagggaagacaggtgaggccgtcaaaagaaggaaagcctcgttgcagggcatgccaccagggagggtctcacaagaagcccgtggaggtccctacgggcctccatccctggccagtggcaagaatgaggaagaatgaggaaggctccctcgggctgggggcacccacaatggggcgcaagcaggcgagcggtgtcagctgcctggggacggctgcgggcagcggggcactcaaacagcaggagaaagcccccacggtttgctggcctcagggacctgagacctgagactggccacctgcaaccaggagacaagccccatgacggcccagcatgtctcccaggccctcccgagaagcctcatctgcaaccaagacgccacaccctggcgagattaaaaactctcaaaaatggggggaagaaaggaaagaagaagccctggagaaaccacagcccgctcttgactcggacggggtagcccgaggcccagcgcccgcccgggagctctgcacctacctgtgaggtggacatgcgagaggtatcttgtcggcctgtgaggtcggacgaggagatgttgacgggggccccgcggtgcagccgcatactcactttccgctctctctccatgccggagacgggccggggggaggtgttagctgaggacagggagagaaacggagtgggccgcccccgtctgctgcctctcactcggggctttctatgagaggctgtggccagagaggaccctgggctgcctggacagtcaggacctggctgtggccgatggccaccaacactcagatccggccggagggacacaaagggacatgggagcgaggtcaaggggctcacaggggaggaacgtgagatgcgggaggaatcacgcacaccagcaggtgccggcatttctaaaggcgcctgggcagcctggctcatccaccctcaggagcgagcatcgcctgacacagggcacttagtgtccaccaccaagtaccctgttgtccccaccaaccccaagacacaagaagtcaccccagagccagccccagagcgctgggaggggggcactcacccgtgtgtgaggtaggggtgaggggtgtggggggagccacttcctgcgtcccccgcaggcggccggaggctgtggaagggaggccgcgggtagccgggttccgcgagtgtctcagccgctcctctcggtccctgcgctcccgctcggcgtcatcggcggcccggctggcaccctgaggaggcaggaggtgaggccggaatggaaccagctttggcagaaagcaaccctaggtcctaggctgccccggccacgtgagaaaatacctaccaaagggcactgggacgagactgcctgcaaagccccccacaggctgcacgtttctcctcatgggatgacagcatcatccccacaaggggtcagagccaggcctctcagctcccccaacaatcgaaaaaaccccactcgccatggcatctccctgtgggctcagaacttccttaaacttccaaatgggcagcagctaccccctgctgctctgtgaacatgctcactaacacgtgcagaaagaggagagggacaggaaccatcggaggccaaagacaggccccaaatggtgacagctggggaggaaagcggggtggggatgagagcgtttggtcggacgaggagtacactcagggtccggaccctgcagcctccaacagcctgtgcaggtgtggtggcgtggccagcagccggcagccggatctgtgctgcactatccagatgcacgggggtggggaggtcagattttaagccgagacagcaacctatgaaaaagcagattctaactgccaatgctgtgcggcaggggcctgcaaactacagccccggggccaaacccaggtgccacttcttcctgcaagtacagctcattggacacagccacgttcaccaggcaacacacagaccgacacacctgcggctgcagcaccgtgcggccagcaccgcccagactcctcatgctgccatttacggaaaacgctggcctagcctgctctgagggccgggtgactctaatgccgcaggagggtcgctctgattcctcccgaggcagcacagccccggcagagggactgatctgccctgccgagtgcacccctcccggcacctgggccccgaggctcgggcctgcctcgcctgccatctctccggggcctccaagtactccccacgctgatgggcacttggcaagtaagtcaagatgaacagagtgcacccctcccagcatctggagaccccgcccctccctggcccctgcacgactactggacaaggctgccgtttttgtaccctcccaagaggcagttctgctcctccatcagactgctgcctggaaaagctccaaattctatttaaaactgacaacaaaacagtaagtttttaatgaaggaacacaacagttccacaggagcttcatttctgacagcggtgtctgaaaagtaattcagctcagacatggacccagggctgggctgcctgttttagaggctccactgcatactcacaccgcatcaagaaagccacagggaaaatcagctcatgacagggtcagtcaggctagacgggtagcacctcaccaggccccaaccccactcatctcgtgggcaccacgaccatgtggcacagcgaatgggaatgcgcacccccagcccccaccctctgcccccagggcatgctctgggccctagctccgcttggtgacagggagggaaggggcctcctgctgtccacacccaggaattccatggacccctctgcgttccctaatggcgtcttacttcttggcacccctttctggcaggcagacacccactcagtccaggtcctgcccactacacacttgcccttcacaaccagagacactccctatatggtacagcccctcaacaagacggccgccggcctctcactgacaagccatcccccgcacaccacactcagcgaacgtgctggcagtgcgacttacaaatttgagcatgttccagtcgaacacgtagtcataggagaagccctggcgatggaacagattccggaaaagctgccgcaggtacgagtagtcaggcttgtcgtcaaaacgcaaggaacggcagaaattcaggtatgtggcaaattcggctacaaaacaagaaactcaaagctaactcatgaaacccaactgcgactcaaggtgtctctgccaacgtcgctgtctacctcctgctgctgcacactcaaggggagaaggacagatgcaaaacacctgtcagatttctaagacctgaagccttgagaaagcatcgaaaagtattcaagtcacggccgggtgcggcggctcacgcctgtcaccccagcactctaggaggctgaggagggcggatcacgaggtcaggagatcaagaccatcctggctaacacagtgaaaccccatctctactgaaaaaaaaaaaaaaaaagttctagagcgtggtggcgggcgcctgtagtcccagctaccggggaggctgacgcaggagaatggtatgaacccgggaggcggagcttgcagtgagccgagatcacgccactgcactctagccttggcgacagagtgagactgtgtcttaaaaaaaaaaaagaagtcataaagcacaatttagtttcatttgaggtgtgtatcctggggcaatcctacaaatgcaaaggaaatctcccgagctcctggagggggccagagagggcagccactgcagagagaggccccaccactgcctgtccatccctttccagccacttggggccctgaggctcgggcctgccttgcctgccatctctccagggcctccaagtactccccacgctgatgggcacttggcaagtaagtcaagatgaacaggagggcaggctgttacctccatacacaaaagcgccccgctttcctgccaccacccctttggaaggtgagcaactcttctgacaaaacccagactgagccgtctcggcacacccgacacatatgcaacccctgtgagcagctccgctgagaagaggcctccagagacttacaagggtagcctttacacaacacttcgatgggggtggacattttcttctcgctaatcctttcgtatttctgtctcttggtggcagccttcagcccctgccaggggagagagcccaggttgaagtacattagcacgtagcccagagactccaagtcatctcttcgggattgttctgaaaagaaaagggaaaggcgtgaagaacggcacttgcgtgctcacgtcaaagcaaaagacccggctggccgttccagtggagactagcctcagacacacatgcccagatcactccagctggcacttccagtggagacgaacctcggacacacatgcccagatcactctcacccagagctgcccctcatgcatactaaggaaattcccaaacacatcacaggtgactcagaaatgtcccagcatccgcctgcccccatacacctggcagtcacgagccagcctgtctgccgcaaaggtctgatgacacgcttgcagccccagctccccgagaggctggcctctccctgggctgaggcatggacgcgcccaaaggcaccccaggtcagtgaccccatgcccaggggctcaccaattccaaggtgcgtgttgatggaggcgtaccgcgccgtccccgtgaggttcttgttctcacgataggggatgtgctggtgggtgcgtgcatcccggtacttcttggccagcccgaagtcgatgatgtacaccaggttgcccttcttccccaggcccatgaggaagttgtctggcttcacatcccggtggatgaagttctttgaatgaatgtattcgatgcgactgatctgtgagcagagcaagggcgcgagatggcaccccagggcagtctcagggagggaccgctcaactgtgggacactacatcagtggctgcattgttcctgcccctcagccacagcagggtagtttaacaattagcgagggggatgccgaactgaccaaattgttcccccaggtgcctgcagcaaccctccacactccaccctccacaggcctaggcgctttgccttcagctcccacaaaacagagaggtgaggcgacagagaggggacaacccgccactagacatcggtctctcccagcactgttctctgcacagactacacaccaggattagcagagaaactgcacggaggtgcttaggaatcacgtgtgttcctgagagactgaggaacccactgaatggaaacgtgctatgctggtaccgagaaggtggcctccaagccagtgagctgagccaccagagcctcgagaagccagtgagctgagccaccgaagcctccagaagcctcgagaagccagtgaactgagccgccggagcctcgagaagccagtgagctgagccgccggagcctcgagaagccagtgagctgagccgccggagcctcgagaagccagtcagctgagccgccggagcctcgtgaagccagtgagctgagccgccggagcctcgagaagccagtgagctgagccgccggagcctcgagaagccagtgagctgagccgccggagcctccagaagccagtgagctgagccgccggagcctcgagaagccagtcagctgagccgccggagcctcgagaagccagtcagctgagccgccggagcctcgtgaagccagtgagctgagccgccggagcctcgagacgccagtgagctgagccgtcggagcctcgagaagccagtgagctgagccgccggagcctcgagaagccagtgagctgagccgccggagccttgtgaagccagtgagctgagccgccggagcctcgagaagccagtgcagtgcgctgagccgccggagcctcgagaagccagtgcagtgcgctgagccgccggagcctcgagaagccagtcagctgagccgccggggcctcgagaagccagtgcgctgagccgccggggcctcgagaagccagtcagctgagccgccggggcctcgagaagccagtcagctgagccgccggagcctcgagaagccagtcagctgagccgccggagcctggagaagccagtgcgctgagccgccggagcctcgagaagccagtgagctgagccgccggagcctccagaagccagtcagctgagccgccggagcctcgagacgccagtgagctgagccgccggagcctcgagaagccagtgagctgagccgccggagcctcgagaagccagtgagctgagccgccggagcctccagaagccagtcagctgagccgccggagcctcgagacgccagtgagctgagccgccggagcctcgagaagccagtgagctgagccgccggagcctcgagaagccagtgcggtgagccaccggagcctcgagaagccagtcagctgagccgccggggcctcgagaagccagtcagctgagccgccggggcctcgagaagccagtgtgctgagccgccgggggcctcgagaagccagtcagctgagccgccggggcctccagaagccagtgagctgagccatcggagcctcgacaagccagtgagctgagccgccggagcctccagaagccagtcagctgagccgccggagcctcgagaagccagtgagctgagccgtcggagcctcgagaagccagtgagctgagccgccggagcctcgagaagccagtgagctgggccgccggagcctcgagaagccagtgagctgagccgtcggagcctccagaagccagtgagctgggccgccggagcctcgagaagccagtgagctgggccgccggagcctcgagaagccagtgagctgggccgccggagcctcgagaagccagtgagcggagccaccggagcctcgagaagccagtgagctgagccactgcagcctcaaggctgaggctcagcaaatttccatttcctctgtgaattaatggccataataatggcaagaacagcacaagcgagtggctgattctatcagacagcaagtgtgtgccaactgtcaggaaacagtccttaccatttggtcagcaagcagcaggacggttttgaggctgaatttcctggagcagaagttgaagaggtcctccaggcttggccccagcagctccatcaccatgacgttgtagtccccctctgccccgcaccatctgatggtggggatgcccactaggcaaggaaatcagacacagtgtttcagtccaggccctgcctcagctccacactaagtctgcactgtgcacaccaaggggtcatggtgacaatcctgaacgggggaggggtggtggaggtagaagaccccggcaacgccgctcctcagggacccatcctcgagattaggccccatctattagcaaatggcctgaggcagacgttggatgagggccaagcagacaggagctgtaagggggacaaggaggggatcgaagccccacctccccgactcccgtcttctagggcaggggggcaggagacacagaaagcagccacgatgtgggaaagaaaagagctcaggcataaaggagcagcagagcccgccagaaacgtcacacaggagatgggaggagagaaagcagctaccgtgggttaggtgagagaagaaaatatgttcaattactccgatgttggtagaagtatttgactggataagagaaaagcaaaagcaatgaaaactttttggggatttacacagtaacccaggattgaaatatacaaatcagggaagtgaaaataaagacacaataaatccaacaggaagaatttaaagatggctgcatagtatcagtgctgaaggcataatcaacactataaaggcacacgggccaggtgcagtggctcatgcctgtaatcctagcactttgggaggctgaaacgggaggactgcttgagctcagaagttcgagaccagcctggataacaaagggagacccttgtctctacaaaaaattctggaaattaggtgggtgtggtggcacgcttctgtggtcccagctacttgggaggctgaggcaagaggatcacttgagcccaggaaatggaggctgcagtgagccgtgatggcaccactgtgctccagcctgggccacagagcaagaccctgtcaaaaaaaaaaaaaaaaatccattttagaaaaaatgggtgaaagacctggacacttcacccaagacgttacgtatgaaaagtcaacgaccacaagaagattctcagagagatggaaaacacatgctggtaaaaacatgcacaggaatgtgcaccgcagcctcacgccacagtcaaattcaaatgctgcagcaacaggtgggtttctcaaaatgccacccccaaaatacgtcctttggtcctatttttttttctcatatccacaagaacatgtctcttcggtatgttttcacagcactggatccgcaactatacacatggctctacacacatacggcttgtgaacggcctggataaaccttttatgtccttccatggcaagacagatttttagtttagtcttaaagcaagttttggtaccactagggaaattcaattcatttaaaaaattgtttcattattttattgttttgagacgaggtctcgctgtcacccaggctggagtgcagtggcaccatctcggctcacggcaacctccgcctcctggattcaagcaattctcctgcctcagcctcctgagtaggtaggactacaggtgggcgccaccatgcccagctcattttactggccacatgtatcgcctctcctctgaaggcatgtatttttttttttggctaagtttttctatcatggtatctttttcctattcatagtagttctttataacttctagatactaaaccactgcaggttttttgtgaggcaagtatctctcagttaatggcatgttttttattttcttctggagtttcttgatgaaaagacttttcatgaatatgaatgccttaatcttttgctttatgagtgctttcagtatcttacattaaaaaaatagtttctgccctcagcgtcaaaaagagatgctattgtttttttttaaagtgttaaagttacttctacttctaacaaaaacagtaataggggcctgattcgccctcacaccttaagtaactaagggaaagaacaaaacacacaccctcacacatcacagggtggtttccacaacactgggcccggccaatgactgacagccgtgccagccagtgacagctgtgcctgagggcgggaaggagccgtgagagggcgccctgggctgccccctgcactgctgggagcataagcacaaacgccagactgaacagatccatggaacccaacctcatcccagaagagagctgaggaggagcctgcagaatgtggaagagcacagcatgcgtgacattctcaatgtccggcatccaaagtggaaaacaaacctggagtaagaggttaactgaacagacccggatgttcacatcagcagggaaagccatgaaacgttactacagatttcgactgtattccaccgtcgaaaagttttttaactggccaggctcaggcctataattccagcacgttggaggtggaagtgggaggatcacttaagtccaagtttgagaccagaaagaaaacatactgagacccccgtctctacaaaaaaattttaaaaattagctaggcatggtgctgtgtgtctacagtcccagctactcgggaggctaaggtgggaggatggcttaggcccaggaagtcgagactgcagtgagccgtgattgcaccactgcactccagcctgggtgacagaatgagaccgtctcaaaaaaaaaaaaaaaaaaagttaaaggcatgaggcatatacatatatatgtgtatttatgtttcggtcttttatatatatgtatatatttatataaaaaacataaatgtatatataaacctgaacatatgtgtatatatatatattatatatatgcaaatacacatctactttcagatttgggaatagttgcattctgcgtcacagtcgagcatccctaatctgaaaatccaaactgcccccattagcatctcctttgagcatcatgttagcactcataaagttcccgactttgggtgtttcagatactcaaccttattacggatttgtgaattcttttctctctctagatgcagcattacggattcccaaattccctttctccactccaatgagtcacagttccttcttcttaatactcattttggagttttcactgtcccaaatttaggcaacagatcacctttcaaactttttcccgtacctcataacaaatgcctgccatgtgttccagattcaccttctttctttctgccccagccctggaatcagctgcttctccaagcactcaggactcctcttaacagagaatgataaatacttagaaacccctgaggcccggtgtgctcagtgttctaggctgtcctccttctaagcccttctcgtggccagaaccacacaaagtatcatcacgacagctttatagtaagtgctggtgtttgcagggcaaatggccctcttcttcacaagtgttttaattaatcctggacttgcactcttctcagtgaattctagtcaccttgtcaggaaagagaagtggctggatgtcgatgggaacgtcattgaatgttaagagcaactttgggagacctgacacctggcatcttcctttctctgaacatagaggagaattaagcaaatcttccttaaatgtccttcaataaagtttatatattttctgcatgcagatcttatctgtcttaaaatttaccccagatacctttttgctactgtaagcattatgttttaaattacattttgtaaccaattaaattgttggtttaacaaaatgaattgattttatattttgatcttaaatttgctcaactctctaatctgttctgagatccctatttaggaaattacatcacatcacatgccagtaacagcagttttatttctgcctttttcaccctctgccctgctgaaaacagtgttgtgaggctgaggatgatgtgggttacacaaaacttggctgcactgcaggggggaatggaaatctacataaccaccttggaaaaatcgatatgtatcaatatgcagacgtctgcgttatcctgcagaactggacatttgcacgtaccaagcaacagccactgcaacttcacacgtaggtgctggcatgtgtgccccagacacatggacaagatgtgcacaaaagcactgtccctaacagcaaatgctagaagctccccagggctcaacgcagtatgagtcagacgaagctactgtatacagctatgtagatgatcaaacaatgaaaatcaattacctagagctgcaatcgatggggaagaatctcaggaatactctgggtcaaagaaaggtacagaatacagactgcatcgcgtaacactaaaactttcatgtattcaaaagactatgtggcatggactcctgatccatctgaactgatggtgtactgagtgatgtgactgatggtgtactgactgatggtgtactgactgatatgactgatggtgtactgactgatgtgactgatggtgtactgagtgatgtgactgatggtgtactgactgatggtgtactgactgatgtgactgatggtgtactgactgatgtgactgatggtgtactggtgtactgactgatatgactgatggtgtactgactgatgtgactgatggtgtactgagtgatgtgactgatggtgtactgactgatgtgactgatggtgtactgagtggtgactgatggtgtactgactgatgtgactgatggtgtactgagtgatgtgactgatggtataccgagtgatgtgactgatggtgtactgagtgatgcgactgatagtgtattgactgatggtgtactgagtgatgtgactgatggtgtactgactgatgtgactgatggtgtacggactgatgtgactgatggtgtactgactgatggtgtactgagtgatgtgactgatggtgtactgagtgatgtgactgatggtgtactgactgatggtgtactgagtgatgtgactgatggtgtactgactgatgtgactgatggtgtactgagtgatgtgactgatggtgtactgagtgatgtgactgatggtgtactgagtgatgggactgatggtgtactgactgatggtgtactgagtgacgtgactgatggtgtactgagtgacgtgactgatggtgtactgactgatgtgactgatggtgtactgactgatgtgactgatggtgtactgactgatgtgactgatggtgtactgactgacggtgtaccgactgatgtgactgatggtatactgactgatgtgactgatggtgtactgagtgatgagactgatggtctactgagtgatgtgactgatggtgtactgactgatggtgtaccgactgatgtgactgatgatgtatttactgacaccatctttctttaacaggggtcctgctgtcacccaggctggagggcagtggcaccatcacagctccctgcagccttaacctcccgaactctagccatcctcctgcctcagcctccagagtagctgagactacagatgtaagccactgcacctggcctgtttctttttcctccctaccccccaaatgtctcagcagaaatcaccccttttgttagctgtaagtaacaatgtaccccgtcatccatggcattagagaatgaataaaatacagtaaaagcaacatgctcttgcctctcaatgcacttgtgctctatggacttactgctactggtgattttgcaggaacaagtgaagccaatgggtttgaaaagagaaccaaggctgcctgcgcccaagtgtgctagtcatccagggccaccctgctgccctgcccaggtgctgtcacggtgggaagcggccactcatgctgctatttgtagtctcaacacttttccctcatggtgcccgaaggtagctaaacatatgcgtggggataaaaatcgggtggacaaggccagatacatgaagacatgctccactctcatctgtgaaaagtttcaatataaatgtggggactgagcattaatgcaaatagaaattttcatgaagttttcagcagttgaaccctaaaatgatttatataactaaaatgtttctagataatttcattatttggattttgaaaaaagtttcttgtaggatgacaaagcaacaaaaacttacaaacaggtgagcaaggtcctggcacagacatggggctgggcgggcgaatgggctccacagggagtgttccctctcaggtgggcagggcagggtcctggttgttgattttaatgtcctcgataccgtacatgttacatacattctttggtgttgtacaatatttcacaagaaaaagatgatggaagacagtcgcccaccctcagccacagaaccgtcacccactggcccgggttctacacacgtactcccctcttccctccctcaaaccatgcctaccatctcagccttgacgaaaagcagctgtgaactaagtaaatgtcctttgctgaggggttccccaaggagggagtgagctaaggctgcttttgggggatgttaggattggaaagagcagttacaactgtccccaggttttgcccaccagtccagtaggttttcataaaaactaggtgtctatccaaatcttccaccaacatagctacttttagtttctttctactatttcaggtattgaatctattgtcccaaccagatttgggacaggtgggagcatctggggcacattcctgacagctgaaggccacgtagggtggccgccatttccttctctgggagcagacagctgcttcagcagtagcctggggggctagaatgcccaagttcaagtctgtcctctgtgaagttacacagccttctaaacccagtttcctcatttgcaacataaggctgaagagctcagtacccactgcccagggctgctatgggcagtgaccagtgtgtttttaaggctcattcttcccaagctgcagagaacagaatgcactcgctgtggagctttctcctggaaggcagcatccatcaagcaaacgtaaagatcagaacctggcaccaccacttgactttcacgtgaaaggaaggaaaaccgcaatgagtggtgcttgctgccctttttttcagagatagcaggacaatctggaccacccacagcaaacactgcacaaggggacaatctgtaccacccataacaggacaatctgcacaaggggacaatctgcatcatccatagcagacactgcacaagaatggcagtggcaagatctggtggcttctggatgaaacaatttcttcccattatttgtcaactccccggtttagtctcaaagtgaattcaagaaccaccaccagaattaggccttttgccttctcggacatcatttgttttctaaaatgcagatctttagatctttacagtatctgacgggcgcgatggctcacgcctataatcccagcactttgggaggccaaggtgggcagatcgcctgagatcaggagttcaaaaccagcctggccaacgtggtgaagccctatctctactaaaaatacaaaaattagccaggcagggtggctcatgcctgtaatcccagctactccagaggctgaggcaggagaatggcctgaacccaggaggcggaggttgcagtgggccaagattgcgccattgcactccatcctgggcaacggagtgagactctgtctccaaacaaaaacaaaaaacaaaaaacaaaaacaaaaaccaaaaccttgacagtatccaccaggtgtctgtgcatttaacacagaagacctgacctacattttggaatggtcagggacatggcaatgcgctcgaagcccaaatgggagaaaaaccatttctgaaatcctatttggtttccaggatcctagagaaggtgccatgggcaggaacatgaaggtgcaggcttctttactctcttaagccagcggccacaggggaagcaactttgcctgccaggggccttcagcactgtctgaagaaagttttgagtatcacaactaggggcaggggtgctgccaacatctaccatgcagagaacgcaccactacaaatggcactagtgccgagtggagaagtcctgtccggaaccacgtagcactttttggttcagggttggcttccccagtgaccatcccgggcttctaaggactggctttcttccctttgcccttgtgtacccctggcttgcaagttctcctggagacatctctcgtaaaaacttaaggtgtttttaagcttgcaggttttacttgaccccagcaccaggctcccgcaggccaaggccacaccccgcaccaccctgctctattggctcgtcacaccttcaaggcaatgcaggctccaggcccttgagaagccagtccaccaccaagggccgccagacaggctcccagggcggagtctctgctgagctttccctgggttggtgatgggatttttcattcctgtggcctcctctggtcacgtgaggcccgtgatgggacacactgggtgcccctctctgtaacgggttccccaggaccacaggtgctgccaaagatattttgtgtcacataaacttagaaacgtcggtttcttgtagtagcacagattacgtgcttgtgctgagaaaagatgtcaaagaatcaaatcaacagtcctccctttcccgtgacaaaagggctaacagaggccctgaacaggttttcctttggccagttgcccaaggggactcacccaaccatccacctacaaatgtgccgcggagccttctcactgggagggctccacagacgtggcacagccactcttcagacaaaaagctctgttcccaaagagggctcctgccagaccgaagctctgctgttgagacacacgcttcatggctctgaaatccccgcagagaataccctcctgctccatcagcccaactgtttgaaagtccagggaactcgcaagagctggactctgaggggaggacaggagcgctctgctccacacctggcccaccgtggaacaccaggtacctaaggccctgggctgagggctcgcagaactgggacagtaactgagctggaagaggtcatgatggtcgccaagttcaaaacccttgttttgctcggagaaaacgagcccagagagtatgaagggacttcccccaagctataagcaaagcatgcgaaggagcagaggcctcactcagggatcacacatcaggaaggccccactgagcaacacacgtgccactggcaacagctccagtgaccactgaggggcacacgacaccacggggagcatgcattgaaattcacacaaaatcttttttttttttttttttgagacggagtctcgctctttcatccaggctggactgcagtggcgctatctgggctcactgcaagctctgcctcccgggttcacgccattctcctgcctcagcctcccaagtagctgggactacaggcgcccgccaccacgaacggctaactttttttgtatttttagtagagacggggtttcactgtgttagccaggatggtctcgagctcctgacctcgtgatccgcctgcctcggcctcccaaagtgctgggattacaggtgtgagccactgcgtctggcctattcacacacactcttgatttcagaaaccatgacccaatatgaagcaaaatttaaacaaaaggacaagatggtataagattttttttttttttgggggggacagggtctcactctgtcgcccaggctggagtgcagtggcgtgatctcggctcaccgcaacctctgcctcccagactcaggcgattctcctgcctcagcctcccaaacagctgggattacaggtgcacgccatcacacttggctaatttttgtatttttagtagagacggggtttcactacgttggccaggctagtctcaaactactgacctcaaatgatccacccatcttggcctcccaaagtgctgggattccaggcgtgagccaccatgcccggcccataagatgtttctttgtgttgagggagggtctctggacccaagactctctgaaggaagctgtgactgctttgtcagggtgtggagaacacttccctcccttttgcccagaaccagttttgggtttattttaaccagcaatgctgagttgctgttctcccttgtcaaacagaaccctggtgttgctctgtgactggtaaagacctacctcctccctgcatcatcttgtagattttgctctcaatgtggagctgagggtgtttggttttgacacattcaagcttgatggcaacctcttctcctgcagcaatgtccgtaccttggcaaagaaagaaaaccacaacaggaattacctggtatccaccaaataacccaacatgctggagaaacaacaagcactatgtgttttccatgaaggaccaagtgagggatgtgttctccttcctagcatagtaaggcgggctaatcggctgacacatctctgggggaagttatccatattcccattttcacaacaggacgaatttgaactgcacagaaagtttatgtggcttccatcacccgcccaccagtcttcaggtgctgcagctccctctccacagtggcccttctggtctgcatcctcccatcagccctgcccaaggcccctgcacttgcccgccccagacagcctgtggtagagctccacggtgccattcccttttctccatgctgcctgataggcctccgagggggtggtttgagtttccccctgaggaagggctaggtttttacccaatagccacagtcccagtccacccaggcctggcatcacaggcagcgggagtcatctctagccaacctattgcaggcaaacaccctccaccaggcggagggaggcccttctcccttcctggggacacaaagccagaagaatcgcctgttttcaacgccctaaatgtaccacctaccaacacgcaccggtcacacatctttcatcagtctatggctaaaaccaatgacacatctaataccatgacgatcggactatgagtttggaggcaaaattacactttttatctagaaatgttccatctctgctttactccaataaatgacaaatgtgacaaccaccatccctctcaggttcacccacaaatgctcctgagtttgaatctggcccaaagccttccccaaatccactgcatgaggcatccaaggagctttaaccgaacaggagagaaaaagaagctgcacacagtacatacccagctctctcctcttccctcacgagtcccttcagagtataagacactggaatcggccgggcgcggtggctcacgcctgtaatcccagcactttgggaggccaaggcgggcggatcacaaggtcaggagattgagaccatcctggctaacacggtgaaaccccatctctactaaaaatacaaaaaattagctgggcatggtggtgggtacctgtggtcccagctacttgggagcctgaggcaggagaatggcgtgaacctgggaggcggagcttgcagtgagccgagatcgcgccactgcactccagcctgggtgacagagcgagacaccgtctcaaaaaaaaaaaaaaaaaaaaaaggacactggatccttcccaacagcgtggctatgtggaaaagaattcacactagcttcagcagcccagacaaagccctgggagacttccttccctgagagactgtggtgctgggcaaagcaacttggctagttcttagtgactcggtttctcttgtcaatggagatcagtggtgaggtctgacgtctgtttcatgagagttgtggagatgaatgggttaacagtttcttttactgctctttaagataaggttccctgatgaaaagcagagtaaggtcaagtgagcactagagcagtctgctgatatccacacgtccactgaacacccaggaagcccctcgtctgcccagatggcggcatgagatgtgccacttccagcctgggccccaaaccccttgccactgctgcgttccacaggaatcgccaccaccgggtcaccgccagtgaccattctagatttaagaacgtcacttactatcaacagagactcttcagagtactcgaggtaacaaattttgttcttcctgcctacagttgggacagtctatccaattacaagagaaatgacttcatcgaaaaatgtactgtgtaaatgaaaaaccactctgagttcctctaaggacctggactctgaactcaactcgccagccgggagggagggtgactcatcccactagttatgtcagcagctccctgcacccccaagcaggcgcagtgcagcctcggacagtaccgccaccctcgccagctggcagcccagtgaccccatggcctggggccgatggcttggggccacacagtctgctgactagcatctctcactccacttctctgtagctgataaagctaatgtctgccagtcacacctgcagcactgactgtcgtggggcaaaagtcatcaccagccgctctggcacacaacacgaatcacaccctatcatggggccgggacctctcgctgtgcaagcacacagatgtgcaagcacacagagccagccctcctgtggaaccgacaccaaggtcgccccgagtctctacaggggagtagctggatgcaggtcctgtacacagatgtgaggatggcaactctctggggcctgcagcagggacctcgtcacctgctgggcagaagcatcaagaagcagaacaccaaggtctgtgcattccaaaggcaccacctgcctcaaggtcgctgagcactgctcagaccccctggcctgcagccctgtcccacctcgcccaccgggggcacccccacactctaccagccatgctgctgaaagtcagatcctcaagctgccatcagtgcacaaggcagcacagaggcgctcagtaactgtggctgcaatctggcatcgctgcagcattttgaccttatacacaagttttggcatgcaacaggttgaaaattacaagcctggttcttcaccacaggttaaatccgagaagcactactagaaggggaatgagaatttgaaagaccctgagccctgggtgtcagattcaaaacaaaccaaaacctggtgacacgcagatcaccaggttgtctgggttgtctgtttatacaaaagacattctgtcaacaaaacaaattcaactcttccctgcagctcaacaatcctggtctgctgtgagacagggctttcctcagtccgtgtttgggtatcagttaatgttagtcctacaaaaacaaaattacgtccctcaagttcagcagccaaaagcagatggtggccgggtgtggtggttcacgcctgtaatcccagcactttgggaggctgaggctgatggatcgcttgaggtcaggcattcgagaccagcctggcccacatggtgaaaccccgtccctactataaatacaaaaaaaattagccaggcatgctggtgtgcgcctctaaccccagctactcaggaggttgatgcggaagaactgcttgaacccagaaggcaggggttgcagtgagctgagatcgcgccactgcaccccagcctaggcaacagaatgatactttgtcttaaaaaaaaaaaaaaaaaaaaaaagcagatggtgagttaagcgaacctaaccagagtgtggccctgtcctggcacaggagggtaattctgaattaccagcctggatgctggcaactcccattaaggattgtcttgtcaacaaaaaaaacagggagacgccttgagcagcaggacaaaggtcaactcgcagggcagcggtcagcagtaccacgacttctcattacagatgcttgagttaaggagagtccaaggtcaacagaggctacagccctaacactgcagtgaggagaccccagaagctacaggaagaacaggtggtcgctctcctctcatggctggtcagcatcttggggccctattgcataccaggcaccctgcaggctgcctcttgagaaatcagtcagtgaggggaaaaacgtgtgcttcagagatgaagcagttagctcccaaaagatgcttgtgcacattatgaagtcagtccatccaggtaacaggtggacaaatggaggccctgacaagctgatggtgcgatgggatcaagtacagatgccaacagattcatctgtccagcccaccagccaggtaatccagtcctgccactaacctccagaacacactacaggtgagaacagaggcaggaccagctgggctctcactgcctctctgcatgggccgcctgcggggtgaacacagcaggcctctccctctagcctagcccagctgaacagtcctcttccgccagacacccctgtggttctggggctgggaactcatggtccacattaaggacactggctgttttcaaatgttaccaagtttatttccagtggtactctgccagcataagtgaaagaacttctggtttatggccacaccacatggacacggatgcggagggcggcacagggccggggccaggtcacacaacaggctgccaaggtgtgcgctccacaggtgtgtgtgggctgtgtcaccttcccaacctgccctcctgaagggccttgcggatctggcaatctcagactgaagacagattgttctttttggggtcccactttccaaagcctgggcattcaagaaatagccccaaaatactgccccctttgaaggggcaattttggaacacgacaacctggcagggccctgcagtgagcacccgccctccaactgtcacagcagggtcggggcaggcaggcccacaccacgcttctagcccacaggcactccactgaagcacagccttccccccttcctggtctcaaacatctgaaagcacagaaagtccccggtagaaaaacaagaacccaaaagccaagctcaaagcaaggtgaaccccacctggaggataccaaagtgacaacagtaggaatggtcttaacgatactcatactagaatatacacgacacacagaggtcaagatgaagacctagttcctcgatttatgtgtaactggctgcccaaacaaaactatggtggggatgaccgatccatctcatagtcttcagatcagccatctttgactctaactgccattctgctcagacccacgcttctttcaaactgccttactccggctaacgtgaccacctcgcctttcctccgtggggtcgtctgaaaggaccacagtgtaggctaggagccaatgctgatgggaaaaaaaaaaatcagctgtgcctaaccccactcaagtaactggacgtgtaccctgatgggtggctgtctgggacggctgtctgggggctccaaccccagggtgtcagagccacagccgcccgcaatcccgtatccagcatgactgtatgcccagcgcgaggtgaggcctggagggtagaatgctgagtgaggagacagccttccaccctccacctctggaattacttggtgacaaccacaccaaaatttgtcttaatctatctttggaaagcacaaagttgtttgacaaggtctcagatcagagaacagatagtttcaaagtacttcttatttatttattttttgagacagagtctcactccatcgcccaggctgcagtgcagtggtgtgatcttggctcactgcaacctccgcctcccaggttcaagcaattctcgtgcctcagcctcccaagtagctggaattacaggcagccaccaccacgcctggccaatttttgtatttttagtagagatggggtttcgccactttggccaggctggtctcctgacctcaagcgacccgcccacctcagcttcccaaagtgctgggattacaggcgtgagccaccacacccggcccaaaatactcctttttgatgcctgcctaaaggtggctaatggactggctttgcagtgtaactcagatcctggggttaaaactttcgccaaaatccattgttctataaataagccaaacgacttccattgaccaagcactctgacttcccaaacactgccaagaacacatccagctgaccacctggtataaatgtttaatagccaaacccaaatgtctaaagcctgcttactcagcagtccactaaggcatatgtacaggttcaaaagcaacaatatggcatgtgacagggtcacctggcaggttaaccaggcaccgaaagtatgagccacccatatgtgtggattcgtcctaacgctgtcagcccaccgggtcctgagtcctctctctggtgacaagtgggaagggtgtgagaactggagactgtccacatgtggcttcatctaaaaggtatgaccagaggcattactgacatcccaggggattcctgaccctagctgacaggtgccccagttaaaacacaccccaaagctagggctgctggaacagaaaacagctcccctcaaaggtctgcagcagcccctctgcaggcacaccgcctcaggctacatatcctcaaattcaggggatcttggaataactcgtgcattgcacaatcccactaacaagtgcggaaaattaagttactttaaaattacaaacttgggccaggcgcggtggcttcccagcacttcgggaggccgaactgggcggatcacttgaggtccggagttcgagaccagccttgaccaacatgaagaaaccccgtctctactaaaaatacgaaattagccaggcgtggtggcgcacgcctgtgatcccagcttttcgggaggctgaggcaggagaatcgcttgaacctgggaggcagaggttgcggtgagccgagatcacgccattgcactccaacctgggcaacaagagcgaaactccgtctcaggaaaaaaaaaaaaattacaaacttgaagatttaagccaacctttcatcacacttgtgttcacgtgcatatttttccattgtaaatatgacacaacccaaaaccttctaatcccattgtttttgaaatctaccttgagactgttacagtctaaaggacacctcatgagtacaactacctcatctgcctctcatcttgccagcatcttaatcctgtgtgactttctctacattcacctaaacttaacccttgctcatttgcactcagtcaccgctccaaggccaaggggaaccgttcagagagaacccccagcgggagggcaagccccactcctagccgggccactcccccgctccacacggcatttgggtctttctgacattttcccccacgaatgcaagacaccggggcagcctctgagggggcagccagacagccccggaccgggctgcggaagaaagagcgtggcctttgtttactgcggtgaccttaggcgtagaggaagccgacgcccgcttcgcggccccagccctaccccctcccctcccacggcccgctgcccccacccccgccctgcccctcccccaggcccgcctccccacgccccacccagcccttcccgagtccgctccccacgaccctgcccctacccaggtcggctccccagagaccatgccccaccccgggtcagctcccctatcccctccttccccaaccctcccctctccagaccctgctcccccgacctggtcctgcccctcccccacgtccgctccccactgccctccccacccctggccgcgctagcctagtggccgttgggttctggccacgatccggcggtgccgggacttgcgcggagaccccgcgggggccaccacttccttccgcgatcgcgcttggtcttggcagccgcagggcccgggtcttcgggcggcgggcgggggcggcggggcctcaccgagatagatgtctccgaaggagccgctgccgatcttccggcccagccggtacctgttcccgactctcagctccatggcggcggcggcccgattcgctcctgccctcccggccgcttcctgggtctgaactctgggaggcggcgccgctgctgccgctactgcgggtccggctcccggctccgcccccctcacggccccgctttcaccatcgctttcctgtcgccccgccgctcccagcgcctcaatacggggcggatgggacagtccgagcgccgccgccgctgctccggcccctaccggtcccgcttgccctctccccgccgcggatggactcggatcttccgggcctaaatcccctttcagctgcctaaaggagccgccgccatcgcgctgtgacgtcacttcccctagc

SEQ ID NO: 645 - DNA, 7269 bp, Homo sapiens
gagtcagttaggtaacaggccacgggccccgggctcaggccactgcacggacccagggaacgggctgacagtccagcagaggcctcagcgaggcggcggcgctgcgcacaaacctgaggacctaggcgggtgaggggtctgcaggtccagacgcctgaggggaagcatgccagggtgcccagtgccccccaaggtggtgggcgaggtttctggagaggtcccggaggagcgggcttgggcagcaggggtcaggttcaggaccctctgtgcatgagtccaggttgactctgcaggacggcatttcgagccacctggcatggcgttccaggcctgtgacggggcagtgcaggggtccgaactggcaggcacccaggtcctgaggacttcatggtcgaatcctggtctaaagccaggggtccttgcagagccctgcgccctgcaccctcgagggaactgcctgcaggagcccctggcttgggagggcgcatggctgtgggacgcagggtctcctgcaagggactttcccacccacccctgccccaggcctcccgctcagcttccagcagcctggggtcgtagagcctttgggggacctgctctccgggcagcccccacctgggagatcagctttctcatcccagaggccaggttatttctgggtgggttggcatgcttcctggggggcggcggggggggggttggtaaatgtcaggggaaggccagcctgtggcgtgtgcccacggagaggccaatgcttggtggctgtggcgtgtgctccaggcaggacagccccagggttgtccctggaacaccgggcagtctgtaccttggcccatcacggtgccggggttatcctggaagatggggagtgtgggccattattttgtgccccttccccgtactctacctcctgtggaatcccttgccccaagccatgtgggcagacagctggctccaagtcagcccctggacaccaggctggagtgggaactcctggagccatttcagcatggctggcaccacaggctgggtgaggacagacgatggtgccaggttgtggtctgggggcttgtccaaatgcctcatcttgacacagaagatggccctccccacatgagcgtcacgtggaagccacaagcacctcaggtctcagaacatgctgtgctctcctggtcagtgagtcctggcactgccccaaccctctgccagccctccttgacactaattcaggggcgccgcgtctcctgagggtggccactgtcccctgcctccccacacgccctcgtctgtctcctgaggaccctggcgggcttcaaaccctgggtctgcctgcgtctcccacccccgctggtgcagccagggagactcagaggccttggtacctctttgtgttttgcagggggaacctggggtatgcaaaatgtgtctattcctgtttgttgtatacacatttccttccttggccttgcatggcctgtttatttttaaaagtgcaaacttgcaaccccaaacaagctggggccctgaggccgtcaacccctccagtctcccctgtgacccgcagtctgcgtcctgttcccagtttcattcctcaagtgcatatatttttatttttttattttttttttgagacagagtctcgctctgtggcccaggttggagcgcagtcgcgcgatctcggctcactgcaagctctgcctcctgggttcacgccattctcctgcctcagcctcccgagtagctgggactacaggcgcctgccactgcgcccagctaattttttttatttttagtagagacggggtttcaccgtgttagccaggatggtctcgatctcctgacctcgtgatccgcccgccttggccccccaaagtgctgggattacaggcgtgagccaccgcgcccggcctcagtgcatatatttttaatatcttgtagttaccctgctgtatactgtcatcttagggaccttttaaacaataccagtatgagcgggacctaccctgctgctcagtgaccccaggcagtgtgtcctaaggtggtgtgtcctgaggcgtgcgacactctgtcctgtcccaggcactgtggtgggggcatccggtgtccaggtgcagaggcaaaagctgctcccgggtttcccagaaatggttccgaggcctgggtcccagagagccagtgcaggttggggggtggacctctggctctgtgggggggtctgttctgctccagtgggccgtgtctgccttgtcatcatccagacagccacagctggctcctgggtcccctcgtcaagcagcatttcccagtaacagtgacttcgtggaacacttaggaagcccttaaaaaccatcctcggacctctgaggcagggactccagggggcacagcacctgtggtggggacaggcaggcaggctggatgcggggagggcccgggaggaggagtgaggagccacgcacggaactgctcagactctcccagcaaaggtcctggcccttgtgcatgcctttagttacatgtctgccttagaggcaaagacgagccgtcacgggggacccaccgggtcaggggtctgcggacacgcttgcaggaggaacccaaggaaagggggtgggggtggagccccacagattgcgtcgtgggtgggcgtggagcttgcacagcaggcctgctgctgcctcccagggcgctggttcacagcacggtcccagcagggagaggctgagccggttggactagaccacccaaggtctcaggttgcagctccctggtgaggagaggacaaggtgacttctgggtggggtggggcatgaagatggaagtctgacctcgggttccaacttgactcaaacgagctgagctcctggagtttagaaagggacaccagcttcagacatcgtgggggctggcatggtttgctctcgtgggctggatgggagcctccctagcccctcctgatttcaggctgcagcctatgggtcactccaggcacaggtggggtgagtcaagatctcactggaggagtcactgagcaagagggccggtgggaggcaagggggcatccagggacaaggggccagctctgcccccacttccccaccccacccactctaatactgcagcccctgtgcttccaactgccccctccagcctggggcccagcccctcaccgccagagactgcccgcctcctcttgggcaagctcctggtgggctccactgaagccaaagtgggcccttgggggcaggagagccagagcaaggcacgctccacctagatttagaccgggagagacctggaggatgccaaccccagaggtcctggggcgagctcagtgctggggaccggaggtgccgtctgctgccagaatcatggtgtgcgtggtccctgcccagcacgggtcagccagagcgagccagggcagaaatgacggccaggtcgatgttcctgtcgggggctgcttgtcccaggaggtaatctgagtcctggccgagcccaaaaaagccactgccctttagagccagctgtgagggtgcaggaggcagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccggggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgccccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctcgagtgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggcccgggggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtggggaccagcgtgactcctgccaccaaccgaaacccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtgggccctgggggcagcccgcatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagta

SEQ ID NO: 646 - DNA, 31059 bp, Homo sapiens; identical to SEQ ID NO: 644

SEQ ID NO: 647 - DNA, 10490 bp, Homo sapiens
cacttaaagtcgcccccggcgcggagcggaccggcagaggcgggcagaggcggcgagaggcggcgagaggcgggctgaggcggcccagcggcggcaggtaggcgcggccgcgatgctcgcgcgcgggccggggcccaggagctcccccgtgccgggcaagggggcgacctcggggtccgcgctctcacccccaccccgcccactttgtccatcaggtccgggggcgcccggggcatggactagccttctcgaccccgagcgggccccaccgagggctcccgagagccagccgcgcccctccgcgccctcgcatacctggctgcccagtctcgtctcccccggtccggcccggcgcccacccgtcgggctgccctcaggggctgggctcgggccaggagatggctgcgccggcggccaagcccggtccgggtataaatagctcggtccgcggtggcggggggcgcgggctatatttggtggggctgctgcagccctccctgtatgggtggcctccccgagggagtggggagcacttgcgctcgggccgtggcgctttcccctgttcgcaacaccctgaacactccccgacccacacccgcccttgggcaatgactaacagcccgagaccgtgcagggaagtgggggaccctctccagagccaggctgggctccctgggttcgccctacctccacccctggcccccagctcgtgggaaaaccaggcgcagcctttggtagcctcccacttcctaacccacgcctcagtttccctatacgaaaagtgggttggtcaggagcctccctgggtgttgggccagtcaagagacaggagccgcagagtggaagggaagcccttagctctggccggggcctccaggggtggctggagtcggtgagggacgatggggggagccgaggggcggctgtcctcctctctgtcccagaggcatgggctgaaagggtccctctcctggtgatggccagagtcaggcctgctgggcgggaaatggcagttggcccaccccaaggcccaggggcttgtccatgctgagcacaagggtgggaggtcttgtgtctgttggggccggggagtccaaggtcccagcttcactgcacaggcctggaagtcaggtgggtgctggcctgaccctgctgaaggagggtctattccgccagcgtggtgtggaggcggctgggctcgactccctcatggagggaaggaactgaggaggtgctaggaggccgtgggggggtgtctgcccccagagaggctttgagtgcatgggggctctgccgtggcacgtgcagcgtctgtcccccagggccccatggtgtggacagagtctggggtgggcacctggaggcctggtctcaaggcaggcttggtaacgaccccatgtgaccttgggcagggcccgccatccaggccacccagaaagccatgtggcctgcacgatcaggccagaccccactgactggagcggggcactttactttggaggggcagctaccagagggctctatggatcccagcccagccgtcaggccggacgggtcccccctactggcctgcagtgacccttatgccaggctcggctggctcagcggtgggtcctggggtgacctggccacgtgggacagaagggcctgtgccgctccctccagtgaggtgccaaatgtgggccacactctgggccccagcgggggccttccgggcagtggcgcagagccattggaggtgcccgggccctggggcaggggcggggcgggagcagacagagctcagggcgtcctcctagcgtcacctgcccgagtcaggcccatctgtgaaatgggccacgccgggcagccgcacgcaacggaaccgaaccgccgggctcctgctccgagacccgcagttcacgagtcgacgcccccgagtcccgagccgcgcccactggtcccacctctgcagcaagtggagtcggccccgccctgtggcttcgaggccccgacgcctggcgcggctcccgggctccgctgaccccggtggacccgcgcgccggcaattacggtagcgtccagtagggcgcctactgcgggcaatacgggggctcctcccatggcgcggtcacgtcccccacgtcccgcggctggcggggcggggccgggcggagcatccttccctccccctcccccgggtgggccccgcccagcctcgaccacccgcgccgacccccgcccgcagagccgggaagccggaacccgcaggcgccctccagccgtccctccggcccgggcggggattgcgccgaggaggggcctctcctggcgagggtggagttttgggttccccccttcgccccgcacctcccgccttcctgcctcctcccggtcttcaccttcccccccgggtccccacgacgcccgctgggcggcggtggggtagggggcgcctcctgacccgactccccttccagccttggccttcaggcactggctttagggtggaggggcggccttgcggggtccaggaggcctcggaggtgggggacggcggctctggaccagctccggcccccaccacctcccggccccagggcggtgacagccttgcggagaaggggtcttcaaagctctgagaccccgcagtgccagctcaggattgaagcctgcggcggcacatgcagccttcctttcccaaaggggacttgcgcccagccccacttggggcaccagtgggggctcctggccctggccctgggtgggagtggccaatccgcaaatgaggcctgtgtgtctgccccgccggcccctgccgtcgtgatgtaagcggacacagagcggcagggcacgggctgcgcgaggggtctgcgggggtcagaggtggggcgcagggcccaggcctggggcagccccttgcgcagcgtccaccccctgcaagctcggccccgacacctttgcaggcgcctggggcggggctgccgggagttgctcactgctccttccttgtttgcacaacaggggctgcgggggaagaagggaactgagggaggcccctcccccggtgcagcgccctcccgccctcggcacccctcggcagccaggcgctggccacagaggccgcttccttggtcctcaggcagctcatgggatccaggaaggaaacgaattacccttttcctgccccgcctcctgcctgggccacaaaggcagggccaaagcccatccttcaagggctggagtcagttaggtaacaggccacgggccccgggctcaggccactgcacggacccagggaacgggctgacagtccagcagaggcctcagcgaggcggcggcgctgcgcacaaacctgaggacctaggcgggtgaggggtctgcaggtccagacgcctgaggggaagcatgccagggtgcccagtgccccccaaggtggtgggcgaggtttctggagaggtcccggaggagcgggcttgggcagcaggggtcaggttcaggaccctctgtgcatgagtccaggttgactctgcaggacggcatttcgagccacctggcatggcgttccaggcctgtgacggggcagtgcaggggtccgaactggcaggcacccaggtcctgaggacttcatggtcgaatcctggtctaaagccaggggtccttgcagagccctgcgccctgcaccctcgagggaactgcctgcaggagcccctggcttgggagggcgcatggctgtgggacgcagggtctcctgcaagggactttcccacccacccctgccccaggcctcccgctcagcttccagcagcctggggtcgtagagcctttgggggacctgctctccgggcagcccccacctgggagatcagctttctcatcccagaggccaggttatttctgggtgggttggcatgcttcctggggggcggcggggggggggttggtaaatgtcaggggaaggccagcctgtggcgtgtgcccacggagaggccaatgcttggtggctgtggcgtgtgctccaggcaggacagccccagggttgtccctggaacaccgggcagtctgtaccttggcccatcacggtgccggggttatcctggaagatggggagtgtgggccattattttgtgccccttccccgtactctacctcctgtggaatcccttgccccaagccatgtgggcagacagctggctccaagtcagcccctggacaccaggctggagtgggaactcctggagccatttcagcatggctggcaccacaggctgggtgaggacagacgatggtgccaggttgtggtctgggggcttgtccaaatgcctcatcttgacacagaagatggccctccccacatgagcgtcacgtggaagccacaagcacctcaggtctcagaacatgctgtgctctcctggtcagtgagtcctggcactgccccaaccctctgccagccctccttgacactaattcaggggcgccgcgtctcctgagggtggccactgtcccctgcctccccacacgccctcgtctgtctcctgaggaccctggcgggcttcaaaccctgggtctgcctgcgtctcccacccccgctggtgcagccagggagactcagaggccttggtacctctttgtgttttgcagggggaacctggggtatgcaaaatgtgtctattcctgtttgttgtatacacatttccttccttggccttgcatggcctgtttatttttaaaagtgcaaacttgcaaccccaaacaagctggggccctgaggccgtcaacccctccagtctcccctgtgacccgcagtctgcgtcctgttcccagtttcattcctcaagtgcatatatttttatttttttattttttttttgagacagagtctcgctctgtggcccaggttggagcgcagtcgcgcgatctcggctcactgcaagctctgcctcctgggttcacgccattctcctgcctcagcctcccgagtagctgggactacaggcgcctgccactgcgcccagctaattttttttatttttagtagagacggggtttcaccgtgttagccaggatggtctcgatctcctgacctcgtgatccgcccgccttggccccccaaagtgctgggattacaggcgtgagccaccgcgcccggcctcagtgcatatatttttaatatcttgtagttaccctgctgtatactgtcatcttagggaccttttaaacaataccagtatgagcgggacctaccctgctgctcagtgaccccaggcagtgtgtcctaaggtggtgtgtcctgaggcgtgcgacactctgtcctgtcccaggcactgtggtgggggcatccggtgtccaggtgcagaggcaaaagctgctcccgggtttcccagaaatggttccgaggcctgggtcccagagagccagtgcaggttggggggtggacctctggctctgtgggggggtctgttctgctccagtgggccgtgtctgccttgtcatcatccagacagccacagctggctcctgggtcccctcgtcaagcagcatttcccagtaacagtgacttcgtggaacacttaggaagcccttaaaaaccatcctcggacctctgaggcagggactccagggggcacagcacctgtggtggggacaggcaggcaggctggatgcggggagggcccgggaggaggagtgaggagccacgcacggaactgctcagactctcccagcaaaggtcctggcccttgtgcatgcctttagttacatgtctgccttagaggcaaagacgagccgtcacgggggacccaccgggtcaggggtctgcggacacgcttgcaggaggaacccaaggaaagggggtgggggtggagccccacagattgcgtcgtgggtgggcgtggagcttgcacagcaggcctgctgctgcctcccagggcgctggttcacagcacggtcccagcagggagaggctgagccggttggactagaccacccaaggtctcaggttgcagctccctggtgaggagaggacaaggtgacttctgggtggggtggggcatgaagatggaagtctgacctcgggttccaacttgactcaaacgagctgagctcctggagtttagaaagggacaccagcttcagacatcgtgggggctggcatggtttgctctcgtgggctggatgggagcctccctagcccctcctgatttcaggctgcagcctatgggtcactccaggcacaggtggggtgagtcaagatctcactggaggagtcactgagcaagagggccggtgggaggcaagggggcatccagggacaaggggccagctctgcccccacttccccaccccacccactctaatactgcagcccctgtgcttccaactgccccctccagcctggggcccagcccctcaccgccagagactgcccgcctcctcttgggcaagctcctggtgggctccactgaagccaaagtgggcccttgggggcaggagagccagagcaaggcacgctccacctagatttagaccgggagagacctggaggatgccaaccccagaggtcctggggcgagctcagtgctggggaccggaggtgccgtctgctgccagaatcatggtgtgcgtggtccctgcccagcacgggtcagccagagcgagccagggcagaaatgacggccaggtcgatgttcctgtcgggggctgcttgtcccaggaggtaatctgagtcctggccgagcccaaaaaagccactgccctttagagccagctgtgagggtgcaggaggcagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccggggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgccccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctcgagtgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggcccgggggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtggggaccagcgtgactcctgccaccaaccgaaacccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtgggccctgggggcagcccgcatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagta

SEQ ID NO: 648 - DNA, 3727 bp, Homo sapiens
cagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccggggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgccccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctcgagtgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggcccgggggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtggggaccagcgtgactcctgccaccaaccgaaacccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtgggccctgggggcagcccgcatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagta

SEQ ID NO: 649 - DNA, 4602 bp, Homo sapiens
cctgctgctgcctcccagggcgctggttcacagcacggtcccagcagggagaggctgagccggttggactagaccacccaaggtctcaggttgcagctccctggtgaggagaggacaaggtgacttctgggtggggtggggcatgaagatggaagtctgacctcgggttccaacttgactcaaacgagctgagctcctggagtttagaaagggacaccagcttcagacatcgtgggggctggcatggtttgctctcgtgggctggatgggagcctccctagcccctcctgatttcaggctgcagcctatgggtcactccaggcacaggtggggtgagtcaagatctcactggaggagtcactgagcaagagggccggtgggaggcaagggggcatccagggacaaggggccagctctgcccccacttccccaccccacccactctaatactgcagcccctgtgcttccaactgccccctccagcctggggcccagcccctcaccgccagagactgcccgcctcctcttgggcaagctcctggtgggctccactgaagccaaagtgggcccttgggggcaggagagccagagcaaggcacgctccacctagatttagaccgggagagacctggaggatgccaaccccagaggtcctggggcgagctcagtgctggggaccggaggtgccgtctgctgccagaatcatggtgtgcgtggtccctgcccagcacgggtcagccagagcgagccagggcagaaatgacggccaggtcgatgttcctgtcgggggctgcttgtcccaggaggtaatctgagtcctggccgagcccaaaaaagccactgccctttagagccagctgtgagggtgcaggaggcagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccggggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgccccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctcgagtgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggcccgggggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtggggaccagcgtgactcctgccaccaaccgaaacccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtgggccctgggggcagcccgcatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagta

SEQ ID NO: 650 - DNA, 11095 bp, Homo sapiens
cacctggggaaacggaagttcagggagggcgaggccgtgccccacatccaggcagcgcaggccgcgggccgctcccctagccaggaagagccgccgtccgcaccgggaccggagaggaagcggaggtctgaagggggacaggtcggacgtggcctcagagagggaggatgtgggccccggagctgagccaggcggccggaaccccacgggacccgcgcgcacctccccaccaaaggggccccggcgttggggggcgaggggtcgctgccctggaggacgttgggacctgccgcgctgcgctccgaggcggggaaacggagggacggcggggcggaggggcgaagcgagcctggactccgggggaggcgaggccgggaagacccagtcccgaggagcagagggggcgggccagctccgggccgggggcgccgacggggccggttccggttgggggggtccctgggcccggcggggttgcgggacgcgccgtcggggagctgcggcccgggagcccgtccggaggcggcgcggggtccgggcggggcgcgcaggggcggcgccaggcggtgacgtgcgcgggggacgtgccgcgccagcgacccgagcacttaaagtcgcccccggcgcggagcggaccggcagaggcgggcagaggcggcgagaggcggcgagaggcgggctgaggcggcccagcggcggcaggtaggcgcggccgcgatgctcgcgcgcgggccggggcccaggagctcccccgtgccgggcaagggggcgacctcggggtccgcgctctcacccccaccccgcccactttgtccatcaggtccgggggcgcccggggcatggactagccttctcgaccccgagcgggccccaccgagggctcccgagagccagccgcgcccctccgcgccctcgcatacctggctgcccagtctcgtctcccccggtccggcccggcgcccacccgtcgggctgccctcaggggctgggctcgggccaggagatggctgcgccggcggccaagcccggtccgggtataaatagctcggtccgcggtggcggggggcgcgggctatatttggtggggctgctgcagccctccctgtatgggtggcctccccgagggagtggggagcacttgcgctcgggccgtggcgctttcccctgttcgcaacaccctgaacactccccgacccacacccgcccttgggcaatgactaacagcccgagaccgtgcagggaagtgggggaccctctccagagccaggctgggctccctgggttcgccctacctccacccctggcccccagctcgtgggaaaaccaggcgcagcctttggtagcctcccacttcctaacccacgcctcagtttccctatacgaaaagtgggttggtcaggagcctccctgggtgttgggccagtcaagagacaggagccgcagagtggaagggaagcccttagctctggccggggcctccaggggtggctggagtcggtgagggacgatggggggagccgaggggcggctgtcctcctctctgtcccagaggcatgggctgaaagggtccctctcctggtgatggccagagtcaggcctgctgggcgggaaatggcagttggcccaccccaaggcccaggggcttgtccatgctgagcacaagggtgggaggtcttgtgtctgttggggccggggagtccaaggtcccagcttcactgcacaggcctggaagtcaggtgggtgctggcctgaccctgctgaaggagggtctattccgccagcgtggtgtggaggcggctgggctcgactccctcatggagggaaggaactgaggaggtgctaggaggccgtgggggggtgtctgcccccagagaggctttgagtgcatgggggctctgccgtggcacgtgcagcgtctgtcccccagggccccatggtgtggacagagtctggggtgggcacctggaggcctggtctcaaggcaggcttggtaacgaccccatgtgaccttgggcagggcccgccatccaggccacccagaaagccatgtggcctgcacgatcaggccagaccccactgactggagcggggcactttactttggaggggcagctaccagagggctctatggatcccagcccagccgtcaggccggacgggtcccccctactggcctgcagtgacccttatgccaggctcggctggctcagcggtgggtcctggggtgacctggccacgtgggacagaagggcctgtgccgctccctccagtgaggtgccaaatgtgggccacactctgggccccagcgggggccttccgggcagtggcgcagagccattggaggtgcccgggccctggggcaggggcggggcgggagcagacagagctcagggcgtcctcctagcgtcacctgcccgagtcaggcccatctgtgaaatgggccacgccgggcagccgcacgcaacggaaccgaaccgccgggctcctgctccgagacccgcagttcacgagtcgacgcccccgagtcccgagccgcgcccactggtcccacctctgcagcaagtggagtcggccccgccctgtggcttcgaggccccgacgcctggcgcggctcccgggctccgctgaccccggtggacccgcgcgccggcaattacggtagcgtccagtagggcgcctactgcgggcaatacgggggctcctcccatggcgcggtcacgtcccccacgtcccgcggctggcggggcggggccgggcggagcatccttccctccccctcccccgggtgggccccgcccagcctcgaccacccgcgccgacccccgcccgcagagccgggaagccggaacccgcaggcgccctccagccgtccctccggcccgggcggggattgcgccgaggaggggcctctcctggcgagggtggagttttgggttccccccttcgccccgcacctcccgccttcctgcctcctcccggtcttcaccttcccccccgggtccccacgacgcccgctgggcggcggtggggtagggggcgcctcctgacccgactccccttccagccttggccttcaggcactggctttagggtggaggggcggccttgcggggtccaggaggcctcggaggtgggggacggcggctctggaccagctccggcccccaccacctcccggccccagggcggtgacagccttgcggagaaggggtcttcaaagctctgagaccccgcagtgccagctcaggattgaagcctgcggcggcacatgcagccttcctttcccaaaggggacttgcgcccagccccacttggggcaccagtgggggctcctggccctggccctgggtgggagtggccaatccgcaaatgaggcctgtgtgtctgccccgccggcccctgccgtcgtgatgtaagcggacacagagcggcagggcacgggctgcgcgaggggtctgcgggggtcagaggtggggcgcagggcccaggcctggggcagccccttgcgcagcgtccaccccctgcaagctcggccccgacacctttgcaggcgcctggggcggggctgccgggagttgctcactgctccttccttgtttgcacaacaggggctgcgggggaagaagggaactgagggaggcccctcccccggtgcagcgccctcccgccctcggcacccctcggcagccaggcgctggccacagaggccgcttccttggtcctcaggcagctcatgggatccaggaaggaaacgaattacccttttcctgccccgcctcctgcctgggccacaaaggcagggccaaagcccatccttcaagggctggagtcagttaggtaacaggccacgggccccgggctcaggccactgcacggacccagggaacgggctgacagtccagcagaggcctcagcgaggcggcggcgctgcgcacaaacctgaggacctaggcgggtgaggggtctgcaggtccagacgcctgaggggaagcatgccagggtgcccagtgccccccaaggtggtgggcgaggtttctggagaggtcccggaggagcgggcttgggcagcaggggtcaggttcaggaccctctgtgcatgagtccaggttgactctgcaggacggcatttcgagccacctggcatggcgttccaggcctgtgacggggcagtgcaggggtccgaactggcaggcacccaggtcctgaggacttcatggtcgaatcctggtctaaagccaggggtccttgcagagccctgcgccctgcaccctcgagggaactgcctgcaggagcccctggcttgggagggcgcatggctgtgggacgcagggtctcctgcaagggactttcccacccacccctgccccaggcctcccgctcagcttccagcagcctggggtcgtagagcctttgggggacctgctctccgggcagcccccacctgggagatcagctttctcatcccagaggccaggttatttctgggtgggttggcatgcttcctggggggcggcggggggggggttggtaaatgtcaggggaaggccagcctgtggcgtgtgcccacggagaggccaatgcttggtggctgtggcgtgtgctccaggcaggacagccccagggttgtccctggaacaccgggcagtctgtaccttggcccatcacggtgccggggttatcctggaagatggggagtgtgggccattattttgtgccccttccccgtactctacctcctgtggaatcccttgccccaagccatgtgggcagacagctggctccaagtcagcccctggacaccaggctggagtgggaactcctggagccatttcagcatggctggcaccacaggctgggtgaggacagacgatggtgccaggttgtggtctgggggcttgtccaaatgcctcatcttgacacagaagatggccctccccacatgagcgtcacgtggaagccacaagcacctcaggtctcagaacatgctgtgctctcctggtcagtgagtcctggcactgccccaaccctctgccagccctccttgacactaattcaggggcgccgcgtctcctgagggtggccactgtcccctgcctccccacacgccctcgtctgtctcctgaggaccctggcgggcttcaaaccctgggtctgcctgcgtctcccacccccgctggtgcagccagggagactcagaggccttggtacctctttgtgttttgcagggggaacctggggtatgcaaaatgtgtctattcctgtttgttgtatacacatttccttccttggccttgcatggcctgtttatttttaaaagtgcaaacttgcaaccccaaacaagctggggccctgaggccgtcaacccctccagtctcccctgtgacccgcagtctgcgtcctgttcccagtttcattcctcaagtgcatatatttttatttttttattttttttttgagacagagtctcgctctgtggcccaggttggagcgcagtcgcgcgatctcggctcactgcaagctctgcctcctgggttcacgccattctcctgcctcagcctcccgagtagctgggactacaggcgcctgccactgcgcccagctaattttttttatttttagtagagacggggtttcaccgtgttagccaggatggtctcgatctcctgacctcgtgatccgcccgccttggccccccaaagtgctgggattacaggcgtgagccaccgcgcccggcctcagtgcatatatttttaatatcttgtagttaccctgctgtatactgtcatcttagggaccttttaaacaataccagtatgagcgggacctaccctgctgctcagtgaccccaggcagtgtgtcctaaggtggtgtgtcctgaggcgtgcgacactctgtcctgtcccaggcactgtggtgggggcatccggtgtccaggtgcagaggcaaaagctgctcccgggtttcccagaaatggttccgaggcctgggtcccagagagccagtgcaggttggggggtggacctctggctctgtgggggggtctgttctgctccagtgggccgtgtctgccttgtcatcatccagacagccacagctggctcctgggtcccctcgtcaagcagcatttcccagtaacagtgacttcgtggaacacttaggaagcccttaaaaaccatcctcggacctctgaggcagggactccagggggcacagcacctgtggtggggacaggcaggcaggctggatgcggggagggcccgggaggaggagtgaggagccacgcacggaactgctcagactctcccagcaaaggtcctggcccttgtgcatgcctttagttacatgtctgccttagaggcaaagacgagccgtcacgggggacccaccgggtcaggggtctgcggacacgcttgcaggaggaacccaaggaaagggggtgggggtggagccccacagattgcgtcgtgggtgggcgtggagcttgcacagcaggcctgctgctgcctcccagggcgctggttcacagcacggtcccagcagggagaggctgagccggttggactagaccacccaaggtctcaggttgcagctccctggtgaggagaggacaaggtgacttctgggtggggtggggcatgaagatggaagtctgacctcgggttccaacttgactcaaacgagctgagctcctggagtttagaaagggacaccagcttcagacatcgtgggggctggcatggtttgctctcgtgggctggatgggagcctccctagcccctcctgatttcaggctgcagcctatgggtcactccaggcacaggtggggtgagtcaagatctcactggaggagtcactgagcaagagggccggtgggaggcaagggggcatccagggacaaggggccagctctgcccccacttccccaccccacccactctaatactgcagcccctgtgcttccaactgccccctccagcctggggcccagcccctcaccgccagagactgcccgcctcctcttgggcaagctcctggtgggctccactgaagccaaagtgggcccttgggggcaggagagccagagcaaggcacgctccacctagatttagaccgggagagacctggaggatgccaaccccagaggtcctggggcgagctcagtgctggggaccggaggtgccgtctgctgccagaatcatggtgtgcgtggtccctgcccagcacgggtcagccagagcgagccagggcagaaatgacggccaggtcgatgttcctgtcgggggctgcttgtcccaggaggtaatctgagtcctggccgagcccaaaaaagccactgccctttagagccagctgtgagggtgcaggaggcagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccggggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgccccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctcgagtgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggcccgggggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtggggaccagcgtgactcctgccaccaaccgaaacccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtgggccctgggggcagcccgcatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagta

SEQ ID NO: 651 - DNA, 11095 bp, Homo sapiens; identical to SEQ ID NO: 650

SEQ ID NO: 652 - DNA, 6245 bp, Homo sapiens
agccagtgcagaaacgtttaatagaaataaaaaggtctgcatagagccgaggctcggagccacccctctgccgcacatccagtacagagaggattctataaagttcacactttttcattaagtagtagtagaaatacggtgaggccctgagactggcctggtgagcgaggaaaggccgctgggcgcttccactctgcaggccggggctgaaataacccgagttccgttctcacagaaaggtgcggctgccacctcttgacacagaggccggatgggcaggtgtcctcgatggccaggccgtatcagggtacaaccgcagcagtgcaaggggcttcctcaaggacaaatggctaaaaatgtcacggtgaaaatgtcatccccaaagagttcgttctccctagacccgtgggggcaacccagccttcaccgtgacactggccatctgcaaagtgccaactgttcttcatcgagcacgtgattacgtcactttcttcctttttgtgcgttttgtgcagcccctgccaaaccagccccctaggatgggggccgagctaagcggtgcaccccggtccccaggcggggcctcctctctgcttctgcacagcgacttccgactgtggctgccttcttcaccagcacgcaggggagtcgccagtgagaaaatgggatcctgccacctgccaaaaagggaaagcggcatcaggcgggcctgggagcctctcgcagtcacacctgccccagctcgggaaagctgtctgcggtccctgccttcccatccccttccctcccgtgtcaactgcggcggggctctggttggcggcagcttcattgttaccaagctgcagaacggatgtgggagaggtcacctcttaggtggtgactcaaaggtcggcacccacactagctcggtctcctcaaaactccgtgtccttgtccaccactgagcggcgtgcacacacagggtggggcagcagtggccccagggctgcctccgtctccagggatgagtcactagcaactctgggccccaccttccacttgtaccgctggggcaggtggaccagaccctctcccccttcccagctgactagggaggcgtggcctacagacgaccccgtgaagaaagcatgtgtctgacggagatgcagaaccacagatcataacttaagatacagatacgcactgataaggaaaatgagctaagttaatgtaaaaaaaaaatacagtacacgatagcccacatcacagaacaccacacacataacatacaagaagtgccaggcccagaaggtgaagggatccttaatttcttgaaccctttgattaaaagaagttattgatttcccctataagaccctgaaaattcacagagaaagagagtgtaaactttttactcaatacatacaccaagtctaaattatcacaaattctgtattaaggcacagtttgtttaagctttcccaaagtacgccaactcccaaaaccaagcacacagattctgtctgaccagagctgccgagtgctcgtcccctccagatgcttcccaccaggcatctcggagagctccacggggaggcctggagcaggagcacgcgggcagaatccctctccccgcggggattgtgtgtgccacatcagccagggcaggagtggcacacgcagggtctccgccaaccaccgaggtcaggccctctggagaccaccacgcttcagtcatgcctcaggcaccactgcaaacacctcagagcttcctccacactcagctcacgagagaagacagacaaggcccagcacacagaggtgcggggaagcaggctgctgcagcggctcactcacctgctataggcggggatctccaagcccagctcggccatgaggagccgcatgacgtcatcacacttcccatgtagcttcagggcagcccagtcatccttcggggtccactgaggacagggaaagccgagtgagagtaacagcagcccaacccttcccggtggcctgtcagccttggcccctacgggctcagtcggtgctccctgagcacccacgggggccctatcagaccgccctggtgcatgggtgtggggtgtctctggctgtgcgttctaagacccagatctaaggacgtggctctcagcacccgagttacctgcaggttcacgatgtaaagcttcggccgccggctagggggcttggtcatgcaccagaggcgtgggtacttctttagaacctgtggaagcagacagacagacaccgcacacacacaagggacaagtctgtacagtgctgggccgcagagctggacaccctcgggcgggcaggggctcggttcactcattgtgtcatcggcacgtaccttcaggctggaccctagacacaggatggtgtctgctctgctggcagcctcggtcgccgcttcccagttcagaggctgccccaacgtccccctctccccaaagtgcacaatggtgtcccgcagctgggtcccacacttgtggcaggtccggcctgtctggtgtctgtggagggcagtgcgctccgtcacatcgaacacccgcacgtactccctgttgggaacgcaggaggtacagacctagaggcaagagggcacagtgagtgggacccgcctgcccatggagaccctgggtccctgcaggactgctcacttcaatgtacatgttcccgtggagctcggagatggccgtgcgcggcagcccactcctcaggtggagcccgtcacagttctgagacaccacatgctgcacctggaaggcagaacgggtggcaaggggagggatggctgccagtggtggtggggaggtcagtacccggccacagcgaggctgttctgagccccgccgatggctcccaaaaccaggggcagctccgtccccccagagagccttagaaagtaaaacacacaacaggtccaaccaccaggagtcaagagggcctgtggtggggaggggctgtccttcctccagccctgatgcacctggagtggctgggagggcaagaggttgcaccgtcccggcaaggttgggaagtggctcggggtttggcaagggccactctgccccagatccatgctctcttgggtcatgacatttcaggtccctggggacctaggcagatcaaccactacaccccattggttgagggtgttcagcagaaggtccccagagatgtcctataagcctcccctgtgactaggatggcttctgaggtccacagaaaaatgcaagggaatcacaaaggggaaaggccaccagcagctctgaggctgaggctggctgcggatgggatggttcagagggggagctccccttctgtcctggagagtcaagcacaggaggatcaaacccgcggcctaacccgcttggtgggtgctcatcatgggagtcaactggcagacagagggcgggtgcagttagttgcccactgggcaccaaggtgctctgcctggtccctggcaagtgtaccagccacccagggctcttaccagcttctgctcatgcagacgggtgatgctcatgtgggtgagggttggctcggcctcgctcaggtcggcagcactgccaggcagaaaggaaggcaaggtgaggagagctggagctcaggcccgtgctgccgctgcccagcctatgtgggaggccatgcctggcccgcttacctaacgcttctccctttctgaagcagtgtccacactccattagggccccggtagtctgggatagacgctgcctgcatgtcgagaaaaaaggtaagccaagtcaaaaggcaccactgtaggtactggcagaattcccagaaacggaaagccactgtcactcctgccgcattccgggctggcctgcatgttggcctctattcattccacaggctgacctgcctgagcccatatggagtgtaccccaattcggctcctcccttctacctggacttccgtttcccgcctggcctggctcatccttccaggctgcacgcagccctgcctgcctccggaagcctctctggcaccgagcacaaagctgggctctgtggcacatgtgtcctccacactgcaggggaagactagtcatgttcctaaagtgcccccagggccgagcccacagctcacacatttagcaaatggtgaatccctaggtgggtccaggcgactgtccattctcatgtcccagtgctgactattcccgctccaccttaacaaaggcagaacaacttcttcagatgagatgagcatctaacttcccaggttttcaatcctgtgaaacaaactgaggcccacagagggcacacaagatatgccaggatcaaggtgtcttgtgttcccttttggggactcccgactcctgcttaaactcagaaaaatgcaccacccccccggacagtagttccgacagtcacattcaagacgggaacctcaaacactccgatgaaatccactagctgcatgtgcttttagttgccattggaagttccataacaggtcacgtgactgttacataattacatgactggacttttttttttttttttttttttgagagacggagtttagctctttcgcccaggctggaatgcagtggcatgatctcggctcactgcaacctccgccttccagtttcaagtgattctcctgcctcagcctctcgagtagctgggattgcaggtgcccaccaccatgcccgactaatttttgtatttttagtagagacagggtttcaccgtgttggccaggttgttcttgaactactgacctcatgatccgcccacctcggcctcccaaagtgctaggattataggcatgagccaccgcgcccagcatgactggacttttacatgtgacttgtggagggaggagactaaaccccagggctccgggtatttgagtcagtagtgaactccctttttgcattcttgctgctgagcctctgctgttctttgcttggagtgcctcattccaaccttctgtaaatctcacccatccttcaaggcccaatcaaggccacctcccacaaaaagccaacgcaggtgggtttcccaactccaagagcgcagagtgtgtgtctgagtttgctctagcgacccagcacagccagctttacagtatggttatttgttcacatgcctgatccttgtcacctaaaagcttcctgagaacagaaatcacctgggttcagatctgctaggccgacgcgtgcccaacaccccacacacacccatcaaattagatggacgaggtgccagctacactttcaaagctagtgatgtcccacagcccaggataacttgtcagtgaaacttctcaaaacacaatgcaattctctccttcacctggtgtattctggctcttactgtgtcactttctacttatcttccctcgacatggacagaacagagtggaaaatcacaactttgggcttagctctgtccacataacctgggggtgcctgcgagcagtcggctactacaccccattcgtatctctactccttgttttttttaactggctgtaacacagaggccaagcgtttaaaaagcgtttaccttaggtaagttttggtcatttcgtttctttaagagaaaaaaccttagagctgctttaaaggcgagtttttcgcgattactggagctcatactccgtcctggggtacgcctccgcctccctccctaccgtgctgattcccgcgcctgtgtagacgaccaagtatttggcgttccggacggcgctggccagctcccggaccttcccccgcagctcctccgggtcgtcgcacacctgccaagacgccagggtggtcaccgccccgggccgccccacccgggaccgcccgtcgccccagctgctcccgaaaccgggggcgcccgcgcgccgcacgcggaactcgcctcctcctgccgccgcttcaggccctcgcgccgccggctccggccctgcagctccgttaccaggtccgcgctctcggccagcagccggccctcctcggcgctgcgctccgccgccgccttcctcaggatgcgcgacacctgcgggcaggcggacggtgagcggcggcgcgggccgggcatggccgggccggggagcggcggcggcgtacctggcggaggcgctccctctgctgctcctcccgcaacctccggacccgctccgccgctttgcgctcggagcggctcagacccccggctgccatcgctcccctggagacctgctcttccgcttccgcctcacacggcaggccgcg

SEQ ID NO: 653 - DNA, 80188 bp, Homo sapiens
gttgcttcaggcgcttttattaggttccactgcagggctggggtcaatgtaatgcaaatccaagcccagtgatgcacacctgtgagccgaaacagagccgaagcaggagcacctgtgtcccaggagcagctggttggagggagccagggccaggccccacctcctctcgggaccaggagactggcagccgctgtgttcacctgggcaggtgtgcacccagtcacccccactggattatggtgctggtagcatgagagggtgtgtccacaccaagggcaggtgaagatgcgaggtggggctgagacctccttcccacaagaggaggtggctgagcctcccagggcctgaactctcacagcagggctcacccccaagcctgtatgcttagctctgactctctttggacaataaaataaagtgcattactgaacaaagagtaactcaaaaccagaatcagacaaatcgccaatgcttttcctttagctaaaagacaaaagaaaacatgaatgatgtgaatgccggaacttcagagtaagggaaatgctggtggaggacaacggaaactataatagcgtggtggataaggacgagcgagtgggagaggaactggcaacgcggctctctctagaagtccgtgctgtccagcctctgcccagtggtgggggaaggccttggactcacagggaagcaatgcaggaagccttggccacctaggctcacagctcatctcaggaccagaggagacagcagaggacaaaacttcagtgtgacagctgctaggagggagagcagacagcccgcggtgggcaagctgggagttgcatccgcagcagtccgcttcaacccagctcctctccacccttcctgaccctccacaaaagctctgccgtgaccagacccaacccaactggcccctggtcccaagagcagatgagctgcttgggccttccacttggtgtcccatgccaggcggacctggaggtgtcagccatggccctgaccacttcagaagccaacaggcaaatgttctctgttcatagtgccaagaatgtgggtcacgtgggcttaccccccaggatggacacagaagtccctaagcagtctgcagctgggccagcctctcccgtgggtgcagagcagcccagatgtggccatcattaaggcaaagaagcatcgagatgcccaccactccccgggtaagagccaggccccggcctggccacgccacagaggaacgcagagcacacaagcaggaccccaccacgtgctgttccagatcgcccagtctccctctattggtacactatcaattgtgcagtgccccagggaggtcccaaatggccctcacaagaggcacagcccctaacgccctcagccaggcggtgcagtgggacgaagcagcgtattggggagggccagagcatcggcaccggtgacccagctctcccacccaggccatcgcagggcagcctcagggcaggcgccaccactgctcctgctcagcccgcagtatctgcagttgctgcagctgtgtggcttggtagaaaagtctcaggcactgaggtttacttcaagggagaactgactggtgcccccgtccacactcatcaccctggacacaacctcgggggcttcactaaaggagggaaggatgtggaaactagtctctctcactccccttttgtgcagtttttatcttaaaaaaaaataaataaaagtcttctgggcaggaattactgataactgttattataaccaatgcagactttaaaatcccacctggacatcgggtgagaggaggagggcaggcagcaaaccgacctgcagacctgcagaggggagccgtgtccagggccactgcgtccccaccagacaacagctactagaagaggaaagtggccctcacaggcagggtgcctgccaccaagcagtcagacaagggggtaaccaggagctcccagccagaaaaacatgggggcagggaggccaaacaaaaagcactgaaaataaagagaaggctgggtggtggcagcatcggcccctccctgtgcgccccaattccaggtgccacgtagaggcgagaggtctttccaacacggcgggggacttgtcaacaggattaggcgtgaggagccgctctgcgtttccagtctggagactgcattcagcctgcagaataccagccgtggcgcccgctctccagggaggaacgtgctgagaagcttcagtgggtcagggagcccaggacagccagccccttgttcctccagggctgcccactatggggcagttacagggaacacactcagcaacgcttctggcttcaggaagggctgggctgggcccggtcctagccagcagagggcaggcgccctaggtcctggggaggctgcacatctcgcagtggcctgtgcctggctggttcatgaacgtgcagtgctgacaggcccacatggctgcagtggccgtgtgtgtggagcccccgacggcgccgtactcatggagacctgggagctgcccgccaactgtgcctgcagggtggaagagaaatgagcactcatcatttctggcccaccagagactgccagagtgtgggcatgggggcaggggcaggcagctgagagctccccgcccccaacatcccacccagtgctggtcctgcccacacagcactcccaccacaggcacactttgaagtgcttaatgccctcagaaaaatgcctcctgcaccacagggagtaacagggagcctgtgcttgctggttcctttttgttgcagagggtgcttctccttgtgaataacgtaactccccgggggatgtgcatttgggttgtttccagctttttttttttttttttttttctgaggtagggtcttgctctgtcacccaggctggagtgcagtggcacgatctcggctcactgcaacctccacctcccgggttcaagcggttttcctgcctcagcctcccaagtagctgggattacaggcatgaaccacaatgcctggctaattttatctattttttggtagaactagggtttcaccatgttggccaggctggtctcgaactcctgacctcaggtgatccacccaccttggcctcccaaagtgctgggattataggtatgagccaccatgcccagcctccagttttgagctaatatgaacaaagttgccaggatcattcttctacaatttctttgtggacctgtgtttttatttctcttggataaaaacaaagagtgaggctgggtgcagtgggtcacgcctgtaatcccagcactttgggaggccgaggcgggtggatcacttgaagtcaggagtttgagaccagcctggccaacatggcgaaacccggtctctactaaaaataattagccaggcgtggtggtagacacctgccgttccggctactcaggaggctgaggaaggagaatcccatgaacccgggaggggaagcctgcagtgagccgagaccctgcctcttcactccagcctgggcgacacagcgagactccatctcaaaaacaaacaacaggccgggcgcggtggctcatgcctgtaatcccagcactttgggaggctgaggtgggcagatcacaaattcaagagatggagaccatcctggctaacatggtgaaaccccgtctctactaaaaatgcaaaaattacctgggggtggtggtgcgcacctgtaatcccagctactaggaaggctgaggaaggagaatggcgtgaacctgggaggcggaggttgcagtgaaccgaggttgcagtaagccgagatctcaaaacaaacaaacaaacaaacaacaacaacaaaaaacctacctaggaatgaatctgccggcccacagggtaatgaattgtgtgctgaactttctaagaccctgagacacagttctcgcgagggtggcacggttttgcctcccactcgcaaggtacgagagtcccagctgcttcacatcttcactcacacttgacattgtcgcgtttttttcatttcagccacactgatgaatgtgtaacggcttctcatgttttaatttgcatttccctgatgactaatgatagtgactgttcctgcatctccttttttttgttgttgccgaggctggagtgcaatggcgcaatctcggctcgctgcaacctctgcctcctgggttcaagcgattctcctacctcagcctcccaagtagctaggattacaggcacgtgccaccacacctggctaattttttttatttttagtagagatgggttttcaccatgttggcctggctgtctcgaactcctgacctcaaatgatccaccgcctcggcctcccaaagtgctgggattacaggcgtgagctaccatgcccgacctgcatttccttttgtgaaacgtttcaccctccgcccagcttcttcttctgctttctgtttgattaacaacaggcagagttatttttaagtttcagatagaagtcatgttgtgtgtatgtactgctaatactgcgtcccccattggtgccttttcatgtttctaacagtgccctgtgatgagcacaagtgttttgtttagataaatttatttatcaatttacctatttttatgccagtgtttttctgtgttctaccccaaggtcctgcatcctgcctaaaagaatctttgcgtaccccaaggccctgaagagattcaacttaataactgttttacagtttttatttttttaagacagggtattgctctgtcattcaggctggagtggtataatcatggctcactgtgacctcgacctcctgactcatgggatcctcccatttcagcctccccagaagctgggattataggcgtggaccactcaccatgcccagctaattcttttttttttaatattgtttttttgtacagacggggcttcactatgctgtgtgggctggtctcacacttctgggctacagtgtcctccagctttggcctcctagagtgttaggattatagctatgagacatcatgcccagcctgcttcatagttttaccttttaccattaggcctatgacccatcctgagctgatctttgtgtcttgtgtatacacgtctgtaatcccagcactttgggagaccgaggcaggtggatcacctgaggtcaggagttccagaccagcctgaccaacatggtgaaaccccatctctactaaaaatataaaaattagccaggcgtgggtgcacgcctgtagtcccagctactcgggaggctgaggcaggagtatcacttgaacccaggacgtggaggttgcagtaagtggagatcatgagattgcactgcagcctgggtgacagggtgagattccgtctcaaaacaaaacaaaacaacccatgagggccgggcgcggtggctcacacctataatcccagcactttgggaagccgaggtgggtggatcacttgaggtcaggagtttgagaccagcctggccaacatggagaaaccctgtctctactaaaactaaaaaaattagctgggtgtggtggcagccacctgtaattccagctacttaggaggcagaggctggacaatggcttgaacccgggaggtggaggctgcagtgagctgagatcacactactgcactccagcctgggcaacagaacaagactttgtctcaaaacaaacaaacaaaaaacccatgaaaaaatgcccaacatcactaatcatcagagatgcaaattaaaaccacagtgagataccagtcagaacttacaccagtcagaactgcctattattaaagagttggctggacatggtggcttaccactgcaatctcagcactgaggcgggaggatcgcttgggcccaagagttcaagaccagcctgggcaacatagtgagacctcatctctacaacaaatttaaaaaatcagccagggatggtggcacatgcttgtagtcccagctgctcaggaggctgaggcgggaggattgtttgagcctggggaggtcaaggtgagactgacctcaaatgccactgcacttcagcctgggtgacagagtgagaacctgtctcaaaaaaaaaaggaggggggaaaaaaaaaaggtcaggtgcagtggctcacagctgtaatctcagcactttgggaaccaaggcaggaagatcacttgagcctaggagtttgagaccagcctgggcaacatggcaagaccacatcttttttttttttttgagacagagtcttgctctgtcgcccaggctggagtacagtggcacgatctcagctcactacaacctacgcttcctgggtcaagtgattctcctgcctcagcctcctgagtagctgggattacaggcgctcgccaccatgcccagctaatttttgtagttttaacagaaatggggtttcaccatgttggccaggatggtctcaatcccttgacgttgtgatccacctgcctcagcctcccaaagtgctgggattacaggtgtgagccagccaccgggcccggccaaccctatctcttaaagaaaaaaaaaaaacaccaaccaaaaacattagttgggtgtagtggctcatgtttatactcctaggtactccgaaagctgatgcaggaggatcgcttgagctcaggaattgaaggctgtagtgagctatgatcactccactgcactccagcctaggcaacagagtgaaaccctgtctctaaaagggaaacaaaaaagaaaaaaaaaaaaaagactggtgtcattgttagaactgcatcaaagggctgggtgcagtggctcccaggtataatctcaggactttgtgaggctgaggtgcaaggaatgcttgaggccaaagtttgagaccagtctgggcaacacagtgagacctcattgatacaaaaatattaaaaaattttgcagccataaaaaggaatgaaatcatgtcctttgcagcaacatggatgcagttgaaggccattattctaagcaaactaatgcaggaacagcaaaccaaatactacatgttttcatttataagtgggagctaaacatgggtactcacgtacataaagatggcaacgccaggtgtggtggtacacatctgtaatcccagctactcgggaggctgagggaggggaattgcttcaacccaggaggcagagtttgcagtgagctaagattgcgccactgcactccagcctgggagacagggtgaggctccagctcaaaacacacacacacacacacacacacacacacacaaagagcagggcgggctgaaaaactattaggtactatgtgtagtacctgggtgatgtgatcaatcataccccaacctcagcatcaggcaatatacccaggtgacaaacctgcacatgtaccctgtgaatctaaaataagttaaaattatttttaaaaaacaaacaaataaaaagcaacaacaaagccccaagaattagctgggtgtggtgttgcaagcctgtggtcccagttactcagcaggctgaagcagaaagatcacttgagcctggagtttgaggctgcagtgagttacgattgtgcaactgcactccagcctcggcaatagagtgagaccctgtctctacaaaaataaaaataataaacaaagaattgtgtgaaaagaaaacctcggctgggcgtggtggctcacacctgtaatcccaacactctgggaggcagaggcaagcagatcacaaggtcaggagttcgagaccagcctggctaacatggtgaaaccctggctctactaagaatacaaaaattatccaggcatggtggcacatgcctgtagtcccagctactcaggaggctgaggcaggagaatcgtttgaacccaggaggtggaggttgcagtgaggcaagatcacgccaccacactccagcctgggtgacaagagccaaactccgtctcaaaaaaaaaaaaaaaaacaggaaatggtataaaggtgtttgatgtgtcttttgaaggctgtgttaacagaaggattctagcatttgtccagggccgtagctcccgggcactctggtgctctcagctgcagggactcagggcactcgggctgcacgaggcaccacggtgcgtgaggagtccctgcagcaatgctgacagaaggttctcacgagtggggaatcgttcaggacctggtgactgagggtccggaagacacgcaatgcctgcggtccgttccgtagtgtccaccagcaacaacatggatgctgcaggcttctcctccttacagctttaagcactaaagggaaattctcaaggagaccaaaaggtcccacgcttccggcgcttccataaagtttctgattctcttaagacaatgatgttcaaagtgctcctaggatgcctggagattagtatctctgatgtacaggtttataaaatttacagggctgtgtacctaagacgtacggcctggacaacatgtctgctccatcaccggagcctgccacgtgcctggcagggaggccgagtctctactcgttgcattgccgatggcacctgccaggatgcagctgggtgcggaatccagggcaccaccggcagtggggagctgtgcagagtgggctgctctccggccccagccacggggtgccggggcagggggtgggggtactcactgcacagctgctcgatggtggcccactgctcagacctcttccatgtctgggcgagctcctcatttctggtccgcacggcctccagcagcaagctgatgctgtcctacaagaagccaaaaggaaggttcctcttcgctgtgcctaaggtgagcagcttcctgctagaacaggtttctttctccccaacatcaagacgtatttctgaggacattttaaaaatcttacaggctatcactataaaatgcaaactgccacaacttacatctataaacgcaagtgctaaattgaactagaatttaaattcttcccaaataggcccaagcgggcatctgtgcctctgccttgtgctgacggtgctcaacagcccggaggataggagctcatgcctctcgtcctggaggctgggatggagggcggaagtcttgactgtgagacgtgtcctcctccctcacatttcatccctctgcctctttctcctctcgtgtctggaaaaatgcactctctatcctagccttccgagtcaaactgcaggggattaatgcattaaggatgggcgcagtggctcacgcctgtaatcccaacactttcagaggcagaggcagacagatcacgaggtcaggagtttgagaccagcctggcaaacgtggcgaaaccccgtctctactaaaaatacaacaattagacaggcgtggttgcgggcacctgtaatcccagctactcgggaggctgaggcgggagaatcgcttgaacccagaaggcggaggttgcagtaagccaagattgcgccaatgcactccggtctgggcaacagagcgagactccgtcttaaaaaaaaataattcatatatgagaaacggataaagccttcaggagctctcagtacctccagagaatgtcttccaacagatgactgcaaaaatagtgcagtatactagcaaggtggctctggtgtagagggagcctcacctttcaccacctgtccagacagatgggcagcagctgaacctcggagcaggaggtgcagttccctgggctgactagggaaggcacaggcagggaagaggcacagggtgcctgatgtcaaatacccgagtgagtggttttgagacaaaatacagacacaaaataaactagcaggatacaagaacagctataggcttcctgacagagaaaggccgggggaggaggagcctctctattctgtctccttcagggaaaagttctgagtcagtggcggagcagctcagaaagaatttgctcctttctctttggcatttcctgttggcttgaacagtgaagaaaaagccaaagtcggacccctacacacggcaagaacctcctgggggctgctgcccactggcccccactacccagagcagccacttctgcaaagcactcgccctcttctcccccaacggtgtctcttaaaaatgccaactgtgcagctgtgagcttggggtctggaagctggccaagccttctgggccaaggcaataaaaccagagttgatttaggaggaggggagatatgagtaaaaagcagaggctgtgactctgaaactgttagaacaggaattttttaaactgtctaactctaatgctggaggcagagctaaatcacctctgcttcccattcgattgtaacagatgaaaccgtacttcctcacagaggtgcagacactcaatggaaatgctaaaggtgaaaaaattaatctatcaacaagcttcttgtgaaaagctgctgcctacactctgcccataggacaaatgagggggacaacctgtgaccccgagctttgacccagtttcccaatcatgctctggtctgggaggaaagaaagcaagacacaggcgtctctttgcagccaaagcccacttgctcaagtggacaccacacttggacacgcacctgcagaggcataacttcattggtgaccaggaacagcaagaggtggaaatctgagatggtatccaagaacacagatgaggtattctgagacaaataggtggccaagctatggaagtcctagaggaatgggaataaacatgaatgttccatacagttccccagtgccagaccccgaaacagagctgtttcctactaagacgcaactcaatacactgaatgctgagacacctctccctctgcctctgcaaccacgaacagggtccaagaaagaggagcaggcagctgcaaagcaagctcttgctctcttctcccaagaagatgctctcagcacacctgactacccagatgtgcaaggagacatgcttataaagctgactcagactggccaggtgtggaggctaacacagtaattccagcactttttaggaggccgaggcaggcaggtggtcaggagttcgagaccagtctggccaacatggcgaaaccccgtctctactaaaaatacaaaaaaaattacccaggcttggtggcgcgcacctataatcccagctactcaggaggctgaagcagaagaatcgcttgaacccaggaggtggaggttgtagtgagccaagatcgcaccactgcactccagcctgggtgatagagtgagactctgtcttccaaaaaaaaaaaaaaaaaaaaaaaaggctgactcagacagagacacaaacatggaaatgcgccctggtcccccggtggagagtgggctgcgggaggggcctggggcccccttcacggcagggagacaggtctgacttttcctgtcgagctgtattctccatctagggcagcaagagggaggaatgtgcagggcagccgtgatgcagcacggacatcttcagcagaaccaaacacagagcttcaagagtgcaccccaataactggctttgcacctctgtgagcaccccaagtcccctgggcggatgggcactgaggggatcaaagcatagaagaagctttgtcagccactgaagaaaacctcattatagacattctttgaccaccttctgaaatgtctgttagcaagttatgatttaagaacaaccatgtgtacacagcctgtctacacagtatgcaggcgtgacagcaaatcggacctggcctgatctgccagtgagagcagaggccaacacgggagccacgctaagcagcagatcaacactacacacgggaaagccgaggccaggccgagaggggccacacagccccaaggtgcctaagaagggcagcaggtgaccaggcaggggccaggccaaaccaacagtgacgaggctgctggcagaagacacaaagcaacacatttgggaaaattacgaggtccactgaagatgtggccagtcaggacgtcaggggattagcctttgtggccgtccatcacctagccatgggaagggcgtccacgtgaccagcagtgccccacagtaggccctagctggcctgtcacaagaatgaatcgggagcatttgaaagcttgatgttttctggaaaaacaatactgacactagataacaatcagcagttaccttaaattatgtttctaaagacaaagagctcacctgtgtctcacccaatacatcccggttttcaataggaaatggattttgcgaaatagaaaaagtgtaaactggatccttggggaaagttgttgtgatctaatgaagaaaaacacaaacccatgataaatgaggctgaaaatggtgtggccgactcccagccagcccagagcatctcccagagcccaaattaacgactcctagcaattctgagaatgttctacaagctctccatcaaagggaaccgttatctattagtgtcatctctaaacgaacacttggaaactccgccatcctggagacaaactacaccatatccgggcagcctccggcctgtgcaccggcctcgacgtcggacaaaaagggcactgggactcccctcgtggcacagcttcccttcagagtcacacaggttctctccctctgctatggaggaacgaaaggctggtttggccccttggccaggtgacaggaaaggaacggaagggccaggaggccgccccaggagctgactttgctcaagagagattcgtgtcattggattcggagggcaaatgagcaatcagccagctttcaagacacaaagcacccttcagcagctcactaagccccttctgaatgctgggagccactccacggagctgtgggcttttccaggcaggggtgaatgtaaggcccttgaggaacacagggttcagctcttctctctccctcagagctgatacccaaaggccagctaagtccttcagtccttcactggctcagacaggccttaatgacaacagagggcactttgcacctaagatataatcaatagatgctacagggacagtggtaaatgtgcaagaatcaatagaaataccacttttattcttcgtgacagacacccctccccaaagcagcaccgagttgagttgatgctgcttttctctgcaacacaacagcagcagcagaggtcacacctcttccagatttaggggaactattctggttcctttgggactatttctaaagaatgagtgtggttctggtctgttttctgcatcagcaaaggcagtgagttgttgagctagctggcccaggatttgctgtgccagcgccagccgctgtggaaggacagctgagccaccagcagcatctctggcctgagctggcccttcatgggcaagcggcggggtgggtcatgaagactcgggccgcggtgccacgtgtcggctacatggcctcgtcagttagggatcctgggcctcactttactcttcctcaggatgaagatgatcggagtactcgcctcctgggtgcccagcacggggctggtacacatagtgttggtacacacagtgctgggtcccagctgaagacaggggaggtgctgacctcctgcagagacaaaagcctggcctgctcaggcgcgtcccttgggaaggcctagaaatgaagaaggcggcacccccagaacacgtgctagtgagtgagctagtgggactgacgggggctcttgctggccttgtaactggcccttggaggggaacagaaccaaagtccacacagcccatcccagatgtcccaaggaagggcatcagctcccatcttacactgaagccatttccctaccctacccatcgtctatcagccagatgatgcccccagaacccacaaagaaaccccagtaacactggctggtgccttttcctgcctgcccagccatcccatcccaaggtttaagaaccttggctgaggccagcgcctgtggcccagggctgggcatggagcttgacacacctctctgggcacctgctctcaaggactccccatgcctcacttccacagggtcaaggagcctgggcatcacagagcagaatgctctcccacaaacaagtacttctgaaaaactgcactaaggcaaaaacttaacttcctttataaaagaagaggaaagaagtggggaggctgcttggggtagaagacctgagaaagctggttttaaatcatgcctgctcctcctgggtgcatgctccatcaatctgttttcatcttaattacaccctaggtagtctaaaaaccagatgccttcacggcctaggtaataaatatgttctcgggagctgtcagttggaatggtgcatcgatgggcttggctcgtggggacctgctgttccgaatgcaatgatattttactgcctgaatcacgtgcccatccaatttcaaatgcagcctgaatagatcctggcgtggcagcagcataggaaatgagccgcctcccgtccgctttggacagagctccggtggggctgatgcactggcttctgcaaaggctcatcctgccatccttgctgccctgtggccaatggtacagccatgtctccatgaccataaaatgcctccaaaaaggagctgagacacagggaagatgtggaagagccaggggcctttgtggctcctggagttccacccagtaaaccacgctgagccctcactcaagaacactgagttacaggtgtgtcccctggggaccaccctggacggagtgacccagacacactgtgggctgtggcagctgtgctggggctagggcaagcacctgcacgtgcaggacagctgacagccacacaccaagcacagcacatctggacaagactgcttgatgctccggtgactggagacccaagcaatgggggttcgctgccttccagaggctgcctagcctggggtcagtggtcctttgtactttagtatggggacagttaacccctaggttgacgtcaaggaaataaaaacctgagactaaaacaaaaagcccttaaaactgtgagcatttcagcaacaccgcatgctcagtgattctacaaccacctcctgggtgcctgttctggggtgggcactgctcaaggcagagggtgccttaaattgcagcctcctcccttgagcagccaccacccagcagtcccacctacaaggcgcccaatgggtccacctgcccaagctgtgcatggggggcacttacgtctatgatgagatactccacaggcaggggccgggccagctgggtgatctcgttgccaaacttgtctacgtcctgcaatagtcagaggggaacagcggtgagcaaagacgatcagtagtaatgattttcctttcacatgcttgtctcaccttttatttaattaatttatttatttatttatttattttttgagacagagtcttgtgctgtcgcccaggctggaatgcagtggcgtgatctccactcactgcaagctccgcctcccaggttcacaccattctcctgcctcagcctcccaagtagctgggactacaggcgcccgccaccacgcccggctaattttttttgtattttttagtagagacagggtttcactgtgtttgccaggatggtctcgatctcctgacctcgtgatccacccgcctcagccccccaaagtgctgggattacaggcgtgagccaccgcgtccggccttcactttttaaattacttcaaatcttattgaagtgtatggatagcagaaaggaaaacgtgcatatttttgcagtaaaaccaccttccaccatttcttggagctcattataaccacagcctgaaaaagcagtcgtgctctcgggcactgggactccccactgggagagcacatcaaatgcctcctctccacccatggcgcttggcctggcactcaggcgcgatctgcgacaggcagaagggtctgcgttcccctcaggttggacctgtgccctgtctatcctccaaaagcacatgaatcctcacagtctgaatgctaactcttagaatcttactcacacctctgaaaacccgactttccagaaaccgagtacttggacattaataaaataaaggcatgcacaaatgagcgcacacacaaatatgaagacacgggaaccccacaccaatctgtcaaagtctcaacttgttttgctttgtcagatgcacagaacataaagtttaattatggggaaaaacggccagcatatgttcattaatcataaaatgacaattagatctgatttatgtcaaacatgctgagttcaaacagagctccagaaataaattcataagaaccaaagcttttcattaaagattctgcaagaggggatcacattttctatctaaatcatcacttaacattatataaatcattcattaagtcatatataaattatacatccataatttccaattatagggccttacataaaagtttacgtttattggagctctcagacccgaaatgattgccaagcaaatctccctgaggtgtgcagggtgacaggaggccacccccatcacaaccacaccttcctggggatgtcaggaagccccgctgtcttctgagacaatcatcacaagctgttcccaagtcaaaccaagtccattaccctaatgagaagccccaggcccccatttggcccttggccctgtttcttgcttgaaaattaaattctggctggtccgaaggtggtgagttacctcagatgattgttaacagtcagttacagatccaactccttgttctactctctcccctttcctcactattgtacttgactagtcttaaaaaataataaaaaatttttaaattcaatttctggcctgaaatgtgtctcagttctccataccctcacaccttttctctactcacagctagagagctgccaacaagaacttgcctctaccctcccagagaaaaatggtccaaatagatcccactgatgtttccaggagggcaggagaatgaacctggactctatttccatttcacgtattgctccccgccccatcaaaggctacattcctgcaaatacacagctctgctctgtttgccttccttggacactgaaatgactttccaccgacttgggtgagggtcgtgtgtcctccttccacgtgacgagtggctgccagtcaggatgggcttccgcattctgcgctctgctggctgtgatgggggcgctaaagacacagggcctactgcacggggtcctggggccccaaaagaggtggtttctcaatggagatttggtaggaggcaaaaatcaaatccagtcaaactaaatcaccatttccaaaaatacaggcttgcccctacaagaaataaacctgcaacaactcacacataattagcccatctggaattcatcttcaaatctaattaagctctaatatgcagaaacatttttccagcacctgttcactttaatctccccctctagggatttttcttgttaaatgcccctctctcttttttgtgtcatgctattctctttcaaacttaactacccaactgcatcttttccactccccaagaaaataaaggtgttgtatccccctttcctccctggggaaacaggtcacttctacctctcccccaagccttcactcagatgttttcgccagccaatccctaggcctacacaccattttaaaaggcaattactttttatgggccttagaaaatgtcagttggaatgcgctgggaggaggttgtcttaattctaagtttggcagccgtcaaagtgtcagcagctttatctccacctggagcgaggcaccaggaggtcggaggttgtggccccaacacctcgccacccgccagaggccacttctggaagcagtggcgccaaggtcttgacaccaagagaaatccagggatcgatgtctttgttagctcaaaagcaatggggatgcccagggcacagtggctcatgcctgtaatcccagcgctttgggaggccgaggtgggcagacggcttgaggtcgggagtttgagaccagactggacaacgtggtgaaactccgtctctacaagactgtctccaaacaaacaaacaaacacacacacacacacacacacacaaacacaaaagcatgtgggctttatgccaggacaacagtgaattccattgattgaatggcatcaaccctgctttagaaaaggtaaatgaaatcctgaatgtgctgcttttctaagaactggcaagaaggggcacaaatgacaccaggatctgagccgccacaggataactcagaaaaaacaaagctttcagacactcggttacttttctttttttttgagagggagtctcgctctgtcgcccaggctggagtgcagtggcgcggtctcggctcactgcaagctccgcctcccgggttcaagccattctcctgcctcagcctcccgagtagctgggactacaggtgcccgccaccacgcccggctaatttttttctattttttagtagagacggggtttcaccgtgttagccaggatggtctcgatctcctgacctcatgatccacccgccttggcctcccaaagtgctgggactacaggcgtgagccacagcgcccagctgacacttggtttcttaaaagcaccacttagaaaatagtccagtccgtgtgcaacgactggatgcacacagaactggcagctggcatttctcaggggccagctgtgtgcacagagccacttcgtcctcacaaacacactggtcacaggcactactgctgtccaagacaggaagggttacaaagatgagtgaacctcctaaagcaatcggcaaggacagctggacagctgtgtagagactgggccccccacactacgtgcgcaggctccccgcctcccaagtcagtgccggtgctgcagggccagggcacacgcaggcctccctcctgcctttggggaaccttgaagttgaggctcggaccccaacagccgtctcacactgagtaagactctcccacctccaccgcaagggaagatgcaaaattttctcttaagactgggaatatgctataataagtgattcagaatctcttctgtcgatggcagtttcttgattaattgataaacctgcctgaataatgctggaagcaaacacaatctcctatgagtgaaaaggcttgttttaaaaagttgcgtgctgctgggtcttgtgccagcaaatacaagtgggttacagggctatagcaaacagagcagtttggtaacaacaaaggaatagattgtaggtaagtggcacagaggacgatgaccagaagtaagacatgaggagacacagataccttgttttacaatgaacagtgggactaggtcaaccaggcaaacatctagagaagcacaaaagctagattcctacctgtaccagtatcatgcataaatggattatggatctcaaaataaaattaaatcctaaaagcacggaaagagtatgtaggtagatgcatagttctgggggaaagaattacagttggccgttgcacaacgcgggtttgaactgagcaggtccacctataggcagacttttttcaaccaaacacagattgaaaatacagtattcgagggctaggaaactcatgtatacggaggtctaactttacatataagcaggttggaaggatccactttggggcgtgagtgcatgtggacttgactatatatggaggtcctggaaccaatcctctgtgtcaactgaggggcaattgtacttccaaagtacgatgacaaaggcagaaattacaagaaaaagagttaaggtatctttgaaatcagaaaatatttcagcttctttgtataaaagacaaagaacgaaaacctggcgtgtgtttgcaacacacgacaaagggttaatatacaaagacctcacaaatgaatgccaaaaatgatgaatcactttacaaatacttaagtgcacacagaggctactcacaaagaaaacagtcagtaaacacaggagactccctgtggtcaaagaagcacagagagcggggtcctgggcctgcctggtccttgccagagtcacgggcgcgagggcaaggctggtctgcagcaccacctgcaagtgtccaccctgccacattcccagaggaaacgtgggaggacacacagacccttcgagtacatagtaagcttcggcaacataatcctagttctagcaattcatcccaagtaatttaaagcatgcactaagaatgagttacagggtccaccaagtgctgttcacagtgccagatgccaacaaaccccacggcctgctgagtaagcaatgcctggccacagcaaggggcagtgggttcctcagagataccctctggcccctccacagctggctccttgaaggaacgctgttcccttgctgctcctatgtcccctcagctccccacggcgctctgacccgccccaccccatcactgtgtagtcctcgccagactgcctgtccgcacagctctccagacagaggaccccagcactgtcccttggcaccaggacatcaccctcccacctctcccagacccttctccttgacctctttagagcagccatccttggagttgctcaacgccctcttctcttctccctctgaaccacagcttggctcatctacttccgggttagctcaacgccctcttcttttctccctctgaaccacagcttggctcatctacttccgggttagctcaacgcactcttctcttctccctctgaaccacggcttggctcatctacttctgggttaatttaggctttctccacagatagtctgaaaagggaactattggcctgtatctcttgcctgagcttccagacctgagtcctggcaaccgtctgtcctgctccatcttcaaactctgcgtgctggcacctggactcaccatcctcccacacagacccatggctctactctggcaccagtgccaaccctgctccccaaaaccaggaacctggcttgagcctgtgctcctctctgcacacctgccaggcctccaaacctctcagtcccagcacaccatccttgtccccaaggccacagggaactgacatgtggcctggattgccaacaccaccagcttctcactgggctccccaactccaaaccgttccccacactgcagcccaggatgggtcttctacagcggggacctcccctgcccaccccatccggctgtcagcacctgtccactgcctctcctacctggatttcagccccactcactcctctaaacttgctgccttctcctgactcaggctactggcatccaatgcctggattgttgcaaaagcttcccgcctccagaccacccctcctgacacctccagcaggaacattccagaactcactttccataagtctttccatggcctcccactgtccaccacaagccactccagctagactggccccgccgggtgcatgctgtgctctccaggtacatagcttcagcagattccactccgcgtggcttcctctcacacactctagtctcagcactgtgaatggccacctcggcgcaccctgctccccaacaggacacctccacagtttccaagaagagggaccatgagggacctgctcaccgtggcgccccaggcctaacacctgacccacgggaagctctcaacagataaacggtacgactggtccgttttctcactgctataatgaactgcccaagactgggtaatttataagaggtttaattgactcacagttcagcatggctggggagccctcaggaaacttacaagcatgacaggaggggaaggggaagcaaggcaccttcttcacaaggtggcaggaaagagaagtgccgagcaaagggggaagagccccttataaatctaacacatcttgtgagaatgcactcactatcactgagaacaggatgggggaaccacccccatgattcaattatctccacctcatctctccttgacacctggggattgtgagtcaagatgaggtgtgggtgtggacacaaagcctatccatatcacaaagggtgctagggggcgtccattttcttcttaccaatctacaatatttaattttttcataataaacatacatttcatttcatatttaaaatgttccatatttatttatttagagacagggtctcactatgttgcccaggcaggagtgtagtggtgcaatcaaagctcactgcagcctcgaactcctgggctcaagcgatcctcctgcctcagcctactgagtacctggggccacaggtgcacacagcatagactgcatgcattactgtttagcgtggtggctcacgcctgtagttctagcactttgggaggcaaggcaggtggattacttaaggtcaagagtttgagaccagcctggccaacatggcaaaacccctctctactaaaaatacaaaaaagaaattagctgggcgtggtggtgggcgcctgtaatcccaagtacctgggaagctgtggcaggagaactgcttgaaccagggaggcggagattgcagtgagccaagatcgtgccattgcacatcaccctaggtgacagagcgagactccatctcaaaaataaatagacttcgagctgtctgatgcatgtggatctttagatttgagaccctcctgctgccagcctctccctcctacctggacaacacccccttcacaagttcctggtctaaaaggtggtctccactccagcctcccccttcagctgaccctgtggcttcctgtgagcaagctgatccccaaacctgcatcccatcgctcctgccagctccacccacctctgcctcccatcctcattgtactgacctgtctccagatgccccaaagctgtccctgacacacggaccatgccccttcctctctgtgtgccaattagctcctttgctggacaccaggaagcagtacatgcccatgtcagtatttcccttacgttaataaaaacccaaacaagaaaacttctcaatcccacttcccatactggtgactgtcctttgctctccctggcagtgaaaccccccgaaagagtcatgcagcttgctgatgtgagctcaccccccattctcctctgtgagctcaccccccattctcctctgtgagctcactctcggcagccgcttatctactactcagccaggctcatcaaagctcccaacacccctgagctgctgaaggcaaagcctcctctcctgactcaccagggagctcctttcttgcctgccttccagggcgctatgctcctgcccctcctccccagctcctgcctcccagtgctctccacctcattcccccaaggtggggttctcctcagccatcccctccaggatggacaactcggcctctcaccaggcctcaagcaccaccccaacaccatctgtaccatgtgcctctcccaagcaatgcgctcaccccgggtggtgcctctgcactagcacatcgccgacagatccccagccttccagcctggcctggacaccctggagtctgcctgcctcttctctcgatcacaccacacactcaaccccctcactactgcacagccatctctactctctaccctagtctccttttccagctccgagcccagcagccagagtgatcgtctcacagccccggcacagccatctcccttcagcacctttcagaagccctcatctcacttccaaccatagattcagcttccaagggcccctcccacctctaccccagcaggccaccctgcttatcactctctgtgtggggaacaggctgctgcctctgtctgaacaatctcctccagacacccccagagctgctctgccaattgacaccttctctcccctctcaggactcgacccaccagggcactccaagcttctctacccgttccgctggggtggcccacctcccctgctgcagcagtctccccgatgcagggagcccttctccattctccatgaactccagggcctggcaattcacaggtgttctctaaacatgagagaatggatgccgtgagagcatcgcacagtgaatcaggtcagtgctaccaagggcttggccacccaaacacaacagctctcgctccccgctcagctctgaagggcccagggccagcctcccatgcccacagctgggggcctgggagagacatggcatggaagtacaaaatccccagtggccctgggccagcccacccgtgggcttatgcccgtcagactatttcctcatggctgaaggagaagaaaatagagattttaaaacacagtaaggctggaagcggtggctcacaccttaatcccagcactctgggaggccaaggcgggtggatgacctgaggtcaggagtttgagaccagcctggccaacatggcgaaaccctgtcgctactaaaaatacaaaaaaattagccaggcatggtggcaggtgcctgtaatcccagctacttgggaggctgaggcaggattgcttgaacctgggaggcggaggttgtagtgagccgagattgggccactgcattccagcctgggcaacacagccagactccaacgcaaaaaaaaaaaaaaaaaaaaaaaaaaaagttaataaaatcaccatgtcacaaaagaactgaaagccagccccttgtcaaagtgcccaattgttacttgtcctcaagaggctccctcaaacccaatcaaccaattctccctgccccagaggaataagccctgtggacgcccagacccttggcataggtgcgagcagtgaggagacaactggctccagccagaggggcagccagtcctccacagcaccaaggccacctctcctcactcccccacaacgattacagaaatcagccagtgaaggcagtccatgggaagagagtatactcccggggcgccagccagcaaggtggtaaaggcacagctacaaagccaagtcagattccagacactagagccactgtcccatgtccagaggagtgggaataaaaggactggaggctgtgtgatctctgtggcagaagggtcgtagcctgccacatcctcacacatcacacagacgcaggaaagagcatcccgaaagcagaggcgcaggaataacttagaccttctgggcagagctagtagcctcgctatgccctggatggagtcccagaccatctcaaaatgtctctgggacgtgctgacagcagagacatgcttccatggtggacccaccacaccctagtgtcagagagggaacatgaggagggctcctctgtaccaaagaacacccgaggggcccagacaccacagtgaatcaccagaaaacatggagcatagacagagccagtcggaagacttacttggggaacatttccagagaacttatgattctaggagcccaagctgaggcccagcggttgtcctgcaggctgcagcagcacaaccaggagggccgtgaggtaagcgagctgtggcatgacgggcatgaaagggcaaagctgaagatgcctgcacgtcacatccgtaccaggaggttttcagctatgatgcccgatgaggggcatggacccgagtttcaccttcagtgggaagcagctgaacacctaagcatctagcggtgttctgtgtgtgtatgtatgtctgcatgtttttggaggagtcttgttctgtcgcccaggctggagtacagtggtacaatcatagctcactgcagccgtgaactcctgggctaaagagatccttctgactcagcctcctgagtagctgggaccacaggctcatgacacagcacccgactaatttttttttgttgttgtagaaatgaggtcttgctatgtcacacagactggcctcgacttcctgagctcaagcaattctcccaccttggccttccaaagtgctgggattacaagtgtgagccaccacacctagtctattagtattctttttaaaggaaaagacagaagacagtcaagcgcctcctggctgtacaacagtctacgagtgtgagtcttgtccctgtgtgatgggcaggaggtcccagcctgcccaaacaaaacccccaccagctgggctctggggctgcacataaagctccacagctgcaggctcttggggctgatgggcagtgagccacagccagcctcccgattcgaagaaacacacaaaaacccaaggagcctcccggccagggccaggcctcctccctgcggcgccgcccctgcgcactcacaactgagcgcccatgtgcgccagcacagcagccactgccacgtgacgcagagtgtgtgtgacacacccatgtgcattcatggctggaaagttattttaaactcttcttcctaattatcaagagagatgttagtgtgacttttcagtgagcgacttggaaatatctatcaaaactcgaaaaaccttcctccccagcaattctattttgaagatatacaaagatgtcacaggaggatgtatagggtgttaaatgtggcactttctgtaacaaccaggaagaaccaaaggccatcaacacaagaccaattaaatacattctgatttggccatatagtcaataaatgcactcatttattctccataattacaagtctttgttttgaagttaaaagaatagaaaaggaaacaagaactctaccagatgcaaagagtagttatcattaaatatgttttcttcatgtttttctgcaggggacaaatgttccctttcacaagaaaggtgaaagagaaaagccccacgtcctgccacctggctgccccagagatgagtgaggctggctggccctagtccctcgggaagctcctggtcctcacaggactatgtgtacacccatatgctttcctaaaaaactacacgtgaacgatgacacaaatgtgccttcaaatcacttctccaaggccagcatctgcacagctcccctcatctgtccacaaggctcttcctcgttctcttactggctgcatatgggacagggcaaagctgtagactctcctccctcctgaaggacagtcaggaagcttctactcccaccccatgtgtgagtgcatgtaaatgtatgtccacatccatgtgcaaatgcctatacgtgtcttcaagaaaataacaaaaaaaattggtattatactctaggtatagatgcacttttaattttgctttctaagttttaccccttatctttaaataatttgcaaacacatacctttagtaaccacatgctatcccagagtccagctgtaacttaatatgcccttgggacagggcttttcaattgtttcccatttttattgccagagacaacaacatgataaacagcagcctcagacaaatattggtgcaggttttgtttacaaggcatgtcacctccaaccgcaaagtccatgggaggactaaaaggatgacttcaatgtttgcttttacagttctctttgctccaactgatattttcctgaaacatgagaaatctgtctcaaatcctacagggctataaacaattctgggaagtatttctagcctattctcgctaacagagggcaaataagcactctatgaaaacaacagaatgattaaggaaatgtcacatatttcatgacaaaagggagctccattcctaagtgcaagaaacttacaataacgcatggaaataaaaaagccaatttccaatctgaaaagggtatttaaaaataatcctacagcaaactcacagttaatgataaaatcctaaaagcacttgctttacaattaaaagcaagacaaaggtgccagagacttccactgtcatgagtgctgtttgggagatcccaggcaacactgggaaaagcccagagaatgagaagggctgatgatggaaaggataatacgtgtaggaaatgcgaaagactaaacttataaataataatactgaggaacagatagcagttgctggatacaaaaatttacctgtttcaaacaccaacagtttaaaaatgtaattttaagatagtgctattttgtaacaggcttaaaaaaaattaaagtacctaggaataacctaacaaatgataggtaagacctccacagagaaaactgaaaacctttctaagagacattaaagaacatgggaacgaggcccagcacggtggctcacgcctataatcctagcactttgggaggccgaggtgggcagattgcctgctgagctcaggagttcatgaccagcctgggcaacatggtgaaaccctgtctctactaaaatacaaaaaatcagccaggcgtggcagcgtgcgcctgtagtcctggctactcgggaggctgaggcagaagaattgcttgaacccgggaggcggaggttgcagtgatctgagatcgcaccactacactccagcctgggcgacagaacgagactctgtcgccaaaaaaaaaaaaaaaaaaaaaaaaagagtatggtattagttctggtttaggaaaactggccaatggaatagaacagagtccagtaacatccatgattcctggagatgaccgacgacagagaagcatcaaagattaaaagggaaacaaaagtttgcttttattcccaaaactgtgctcatatagctgattatccacatcgttaagaaatcaaggccgggtgtggtggttcacgcctgtaatcccagcacttagggaggccaaagtgggcagatcacgaggtcaggagtttgagaccatcctggccaacatggtgaaatccaatctctactaaaaatttaaaagttagccaggcgtggtggtgcacacctgtaatcccagctactcgggaggctgaggcaggagaatcgcagaactcaggtggcagaggttgcagtgagccgagatcaggccactgcactccagcctgggagacagaggaagactccatttctggggggggggggaaagaaagaaatcagaggctgggtgcagtggctcacatctgtaatcccagcatctataatcccagcactgtgggaggctgaggcaggcagattgcttgagcctaggagttcaagaccagcctgggcaacctggtgaaatcctgattctactaaaaatacaaaagagttaggtgggcatggtagtgtgcgcctatagtcccagctacgcgggaggctgaggcaggaggatcacttgagcccaggaggcagaagttgcaacaagctgagatcacgccactgcactccagtctgggtgacagagcgagatgctgtttcaaaagaaaaatataggtcaggcacagtgtctcatgcatgtaatcccagcactctgtgaggctgaggtgggtaggtcacttgagatcaggagttcgagaccagcctgcccaacggggtaggagggaggaaggggaggcaggggcctgaatccaaaccagataagaagacccccagcaaaggggactgtggcactgagatggaaagccccttccctcccctcctgcaggaagtgagtgctgggagatgagggtctggcagagactctggagacacaggaatttcaaacatgcagccattctctcccctcaagatgtttgcagctgggtgtggtgtaatcccagcactttgggtggcctcacgcctataatcccaacactttgggtagccaaggtgggcaaatcacttgagtccaggagttcaagaccggcctggccaacatggtaaaacacagtctctactaaaaacacaaaaaattagccgggcaggtggcacacatctgtagtcccaactactcgggaggctgaggcacaagaatcgcttgaactcaaggggcggaggctgcagtgggccgagatcgcgccactgtactccagcctgggtaacagagcaaaactgtctcaaaaaaaaaaaaaaaagatgcttgcaaaagttttaaggtacatgggatacctacatatttaagctgtatgaggcatgaggaaaacaagaaacttctggacagactgtatctcccagcctttcagggccaatgagacaaagatttaaggaagactgtcacctcacaaagagctctaccaggctctcagatggcacccctaaggggttacactgtagaaaaagggaaggatcaacaatagacgaagtctcatcaaaatgcaactcggctctgaccagctacttgccacctggatggagatggacagctcaccaccaccacatttcccatggaggaaaggaaagccctctctggaagaaaacaccctgctggagtctctggcttgtgatacacaatgagcagcacaccacacacactcagcacgccagtaacaaggacagacagacagacggtccacggaaaacacattgcagctgcagacccacatatgctaacccataattagaaaaaaaatcaatcaattaaaactgatgcagaaataagcaggtgatatgagttagtatataagaacattaaaagttaatatgggtcgggtgcagtggctcacgcctataaccccaacacttttggaggctgaggcgggaggactgctcgaggccaggagttcaagatcaacctggccaacatagtgacaccctgtctctttatttttttattttttatttttttgagacggagtcttgctctgtcacccaggctggagtgcagtggcacaatcttggctcattgcaagctctgcctcccaggtttacaccattctcctgcctcagcctcccgagtagctggaactacaggcgcctgccaccatgcccggctaactttttgtagttttagtagagacggggtttcaccgtgttagccaggatggtctcgatctcctgaccttgtgatccgcccgcctcagcctccgaaagggctgggattacaggcgtgagccactgcgcccagctgacaccctgtctctttaaaaaaaaaaaaaaaaaggaaaaaagaaacaaagaaaaaagttgtttttttttttttttttgagacagagtctagctctgttccccaggctggagtgcagtggcacgatcttaatgcaagctccgcctcccaggttcacgccattctcctgcctcagcctcccgagtagctgggactacaggtgcctgctaccacgcccggcttattttttgtattttttttttttagtagagacggggtttcaccgtgttagccaagatggtctcaatctcctgaccttgtgatccgcccatctcggcctcccaaagtgctgggattacaggcatgagccgccgcgcccggccgaaaaaagttaatataactgtatcccctatgttcaaagagttaagtagaaacacaggaagcaattaacaacttaaacttctggaatgaaaactacaatgtctgagatgaacaatatgctggatgagattaactgcagatgagacactgtagaagtccagatcaacgaatgtgaagactaaaagaaattatccaaaatgaaacactgaagaagactgaaatgaaatgaacagagtatcagtaaactgcgggacaacttcaggcagccaaatacatgtgtaactggagcccccaaaggagcgggaaacaccaaaaagagaaaacattgagtagctgcaattggcaggattctaaaaaaggtcccgaaacatctcccacggtcttctcatctccacccctatccttgagacagggtctcgctctgtcacccaggcctgtagtgcagtggcacaatcatggctaactgcagccttgacctccccagactcaggtgatcctcctacctcagcctcctgagtagctgggactacagttcatgccaccacatctactttttgtagagacacagtctcgctatgttgcccaggctggtcttgaagttctggactcaagcaatcctcctgccttggcctcccaaaatgctgggattacaggcatgagccaccatgccaaggacccatcttctcatctttagaaactgagactgtctgtgttgcaatggtcggatttggtgttactgatctcaaagccagtgcatgtagctccacttctggtgagaagccctacgccatggaagcatgagtagcgaatatccagccccagaaacgtgacagaagcctttagtgacaagcagggttcaaccacagctgacaaacggctgctataggcagaatgcacccaaattagaaaggtccaagacaggttcacaccattctccatgtacagagttctttttcttaccatacttttaccttataaaacacatcaggcacgtactgctcactgctagactccttggcgtagccaagctccggggcgtccttgcatggcagcaaacactcatcacggaccagtgccatacactgattggacacctggtacccttcaaagtggacttggttgtcaggaccacctgcaagagagagacctttaaaaagagtctaccaaacggcattcaaaaccagtccatatctgttaactcttcacctctgatcaacagaaaaaacaaaccctcaagagtttgtcgggggtaagagttaaaaaatgttcagtagtcggccgggtgcggtggctcatgcctgtaatcccagcactttgggaggctgagacaggcggatcacgaggtcaggagatcgagaccatcccggataacacggtgaaaccccgtccctactaaaaataaaaaaattagctgggtgcggtggcgggcgcctgtagtcccagctactcaggaggctgaggcaggagaatggcgtgaatggcgtgaacccgggaggtggagcttgcagtgagccgagattgtgccgctgcactccagcctgggtgacagactccatctcaaaaaaaaaaaaaaaaattcagtagtcaacggatgggtggccacagcacaagacctagcacaagacctagcacagtcaggacaccctgcagctccgcacacacttggctccacaaacaggtgccactaaggacatgctctatgagaatctggaaatcaagactgttaaacttttgaaaaaaagaaaagaaaaggctcagattacgcctgtaatctgagcactctgagagggcagggcgggaggactgcttgagcccaggagtttgagaccagtctgggcaacatagtgagaccctatctttacaataaatcaatcaatcaaaaaaaaaaaaaaaagattgttaaacattgtctagcatctgcccctaaaaccaggcttagtgtcatcagcacttgggctcctggttcataataacaccaggggtgtaaacggcagatagatccctaggctcacggtaaggatgggaggataaattcatctggaggcagagagatggggaagcgggtgggagaagagcaagacggaaactatttttaatacaaatccagtcatggtattgtatacacagcagcctctgtcttccagaaacctacacggccgccacacagagttaatgccaccaggcgtcatcacacagtgtggaggtgcaggtgccactccacggccgtgggcagacctgggagcccagctcctccatggtttcaccctccacactgcccaccccatccttctctcccagtctccactccatcgaagcctccagaatgacttcatgtggggacaggagaactacagatcatggctgagaggcggcagtgtggtccagttagaccagatccctgaagtgagctgggcagatgatgccatgggggcagcctgagcctttggaggaggcaggcatgggggagatgcccaccgctgcagaagtgtgcttccagaactgaagttatgtgctgactacaatctcattattttttaggtatttatttattgttttagaagtaaggtcttactatgttacccaggctggtctctaactcctggccccatgtgatcctcctgcctcagcttcccaaagagctggaattacaggtgtgagccactgtgcccagccctcaacatttgttatagttttggatgaaaaaaaaccctcaatacctctatttcagtttctttgacaaaaagaatcacttatgatcagaaaacagaaacgtagtgcacatggctgtcaaacatgcatcagaaagcaaacctgacggccacacaatcaaaaaaggtgagggaggagatagagctggccgccatgaagctctcaacacacataggaggcaagtgatggctggcttcaaaaccctgggtcaaactcgctccaaaggcacagttcaccagcataggattttctccctgccccaaactcaaatgctcaggaggcagccaaccctgcacaaatgaccactaatatctcagcaaagatacaggcacctcacttgcccatgtgcttggtggcataaatgacactgaaagaatgcagggctcagagggagcagaggcaaaggctggacagagcgccggggagccacggtgcagacatctggttaggacaccatgaaaacctggactgggcttggcgcagtggttcacgcctgtaattccagcactttgggaggccgaggcaggcagatcacctgaggtcaggagttcaagaccagcctggaaaacatggtgaaaccctgtctctactaaaaatataaaaattaactgggcatggtggcgtgcacctgtaatcccagctactcaggaggcagaggcaggagaatcgcttgaccccaggtagcagaggctgcgatgagctgagatcataccactgcactccagcccgggcaatggagcaagactccatctctggagtaaaacagaaaaaaaaaaaaaaaaaaaaaaaaacctgctctggtgtttagactggtcattaacacgataggtcattcaagaaagaaaaatctagcagttgagaataagagaaaaatggaaagcagttatttataaaactgaaggctgtttataaacagcaaaattggccatatggataatcttcaagggtaaattcactgagatgaactgcaaactcccctttccacatgcagcagcaggacatacatgtcctgatgggtttgtgtaaccctgccggaatggctggcaggacaagttaactatcattcccttcacaaatcagtcagtcaggaaatccctacgtgggaaggatcacagggcctacaaagaggcagtgacagcaaaacttcagctgctattgaatctgaatgcatttctggttttttaaccagatccccagcaagtaattttaacagcccgtaaatgtagagtatgctagactatgaggacacagatgcccagcccagtgtgtggggtaagttctacactgcactgtccttccacagggaccctcagggtcactcgagcaaagcgcacacttcattggggctcttatactctgaagcctcatgccagagaatacctgagtacaacgaaaggggaaaggggaggaaggacagatgcagagggagaggcgaggcctccgcatcccagccaggacctgagtgctgtcggcaggggcgccccgcaccctatgccacatggctcagtctgaaccttcctgtctaaggagggatgtgggacgggaatgcaacaagtacaatttccaacagcgctatggggtccccgcatggccgtgaccaagaaaccctaacacaggggaaagagcacactttacttgagttagaaaaccttcatccgagctgtagtgattaaaagcacgcatgaggataagcactcctcagtcggccaccaccctcgggaaagggagaccatggcaagtctgagcaccaagaggggtgattcacacagacacaaaggggctgtcactgcctatctgcttataaattaggttatttattatctctcagttctaaaacctttcagtaaataccaattccagaggtgaaaaaagcccaaggatgatctatataatctctcaactctcaacaagaggtatgactcaaattcaaggtggtagcccccaagttagaaactgtaattctaaaaatgtgccagttcttctggcccatggaataatttctccacagacacagtaattagactgggcacagtggctcacacctgtaatcccaggactttttgaggccgagacaggcggatcacttgaggccagaagctcgagaccagcctggccaacatggtgaaaccccgtctctacaaaaaatacaaaaattggccgggtgtgttggcatgcgcctgtaatcccagctacttgggagactgaggcacaagaatcatttgaacccggaggcagaagttgcagtgagccaagattgtgccatggcactccagcctgggtgacagaacaagactgtctcaaaaaaaattaaaaataaaaataaaagatcctcgatttcactcagaataaaatagtcattaaaaccacactgaaatactgtggaactgttccatatcccacaagactctgaatgcccgctacacacttgtgtaggcaaaaaccactacttacaatgatatgagattagaagcaattctgttttataaatagccacaaaacagacaggcacagttgtaatgcacactgaattctctgggactacaatagtgtaagctgaggcaagggcacactcttctgcttggaactgggtggggagctgctgagcctctcaggaagccatgttgctgacggcaaggccagctgagaggcctggacccagccctgtgctcagcccttgcccacacaggccagtacggatcctgctgtgctgtcctcacgagtcagtccagaagcactgacacacctaaacgtatgactttattctgtttctttcctatcactttcccctgatgttacagttaggatactactctgccttccatttcagaattctgtgtgtcggcagcctacattaactatgttacccatgaattttatttctgcatagtaaaggggtatcacaaagtgttctaaaaacaggagttgagtctgataggcttggaaactaccagcctacactactgtacccagatatcagcctacatgtggcaggggtgtggggatgtgacaccgagaagagtatgacgacacttttctccccgtctctaaatacaacgctggccaggcagaattctaaatgacatgagcgcctttgttctctgctcccctcctgggtgcccagtgcccactgcctgatgccccagctgctctccagctaccctgagtcccccacgacagcacccttcccagggtgccctaacaggttctgtaatgcagaattcccagaccctccttcaatcctagcccaaattcccaacccttcccttaagcactcaacccaagcaacaacttaggaaaataaatctgactcggccgggcgcagtggctcacgcctgtaatcccagcaccttggaaggccgaggcgggcggatcacgaggtcaggagatcgagaccatcctggctaacacggtgaaaccccgtctctactaaaaatacaaaaaaaattagccgggcatggtagcgggcacctgtagtcccagctactcgggaggctgaggcaggaaaatggcgtgaacccgggaggtggagcttgcagtgagccaagacagcgccactgcagtccagcctgggcgaaagagcgagactccgtctcaaaaaaaaaaaaaaaaaaaaaaaaaaaaaactgactcaactaattcacttgtaaaatagttaacatgtattaattattaacataattaacgtgtgaaagatgcctatcaccctcaaaaagtatattcatttcaaaaatcaatctaaatgcaccttaaatcaaggaactgcaggctgggcaacacagcaagacttcatttctactaaaaatttaaaaattaggccaggcgcagtggctcacgcctgtcatcccagcacttgggaggccgaggtgggcggatcacgaggtcaggagatcgagaccatcctggctagcatggtgaaaccccatctctactaaaaatacaaaaaattagccgggtatgctggcaggctcctatagtcccagctactcgggaggctgaggcaggagaattgcgtgaacccgggaggtggaacctgcagggagccgagatcgcgccactgcactccaacctgggcgagagcgagactccgtctctagggaaaaaaaaaaaattaaaaattaactgggcgtggtggcgcacgcgtgtagtcccaactacataggaggctgttggggtcggatcacatgagcccaggagtcgcaccagtgagctatgactgcaccactgtgctccagcctgggtgacagagcaagaacatgtctcaaaacaaacgaacaaacaaaaaaaaaaacacaaaaacccggcaaactcaagaatatgcagcaaagtgcaaaaacttcgcagtcagcttgaacacttttctttctttttttccaaatgttttatttatttatttttgtagagatggggacttgccatgttgcccaggctggtctcaaactcccagtctcaagggatcctcctggctcaacctcccaaaatgctatgattacagatgttgtaatcccagcactttgagaggccaatgagggtgactcacctgaggtcagttcaagattagcctggccaacaaggcaaaacccagtcgctactaaaaatacaaaaattagccaggcgtggtggtgtgcacttacaattccagctactctgaaggctggggcacaaaaatcgcttgaacccaggaggcggacgttgcagtgagccgagattgcgccactgcactccagcctaaatgacagtaagactgtcaaaaaaaaaaaaaaaaacccgttttgctttttttttttgagatggagtttcactctgtcgcccaggggaacatccttgtccatatatacatatacatatatatatatattttttttttcttttcttttctttttttgagacagaggctcaccctgtcacccaggctggagtgcactggcacaaactcagctcactgcaacctccgcctgatgggttcaagtgattctcctgcctcagctccttgagtagctgggattacaggcgcccaccaccatgcccagctaatttttatatttataaagagatggggtttcgctatgttggccaggctgatctcgaactcctgacctcaagcgatccactcacctgggcctcccaaagtgctgggattacaggcgtgagccaccacgcccggccaaaaaagtggacttttaatgagagcactggcctagaggagagctctgtggaggtcctgattctgttatgagttttggggtttgtgtttatatagttttatgctgttaagttgttcagaatttttaccataaaaagaaaggaggaatttatatcccacaagcccagtaagaaagtccagtataactaagttaaggataaaaagctaccaaaaagaggaacaaaatatattaacgaggtggtaatatttacagtacatactgtccctgttatacctgtagccactgcagtaacaaacttggatccaaaatgtccgtctggagagagccggcacatgttgggatgcttgttctggaagtctcctgcagtgatgcactcttctgaacttaggaaataggtgtcctaagacaagagaagcagcctatcaaattttacagcatcatgccaaaatatacttctatttcttctttaaaaaataagaactaagccaggagcagtgactcacacctctaattccagcactttgagaggtggaggcgggaggtccacttgaggacaagagttcgagaccagcctggccaacacaccaaaacctggtctctactaaaaataaaaaaattatctgggtatggtggtgcacacctgaacccaggaggaggaagctgtagtgagccgagattgtgccattgcactccaacctgtgcaacacagcaagactctgtctcaaaaaaataaaaataaaaaataagaaccaaactataaaactcaaaaccactttgaaacaagtatctacaattcctaaccattaccaattcctcatctaaaaccactcacgactagaaaggccagaagcactatgcaaaccaccccgccatgggctgagccctgaaaatcactgctttataaaggtaagatgggtttagctctatgagaccaagagatccggccttcattgatcaagaagaacttcttgaaaaataatggggcctgagggctgggcatggtggctcacacctgtaatcccagcactctgggaggccaaggcaggcagatcacaaggtcgagatcaagaccatcctggctaacacagtgaaaccccatctctattaaaaatacaaaaaaattagctgggcatggtggcaggcgcctgtagtcccagcttctcctgaggctgaggcaggagaatggcgtgaacccgggaggcattgctagcggtgagcagagattgcgccactgcactccagcctgggcaaaagagcaagactccgtctcaaaaaatacaaataaataaataatggggcctgaaagctagaaccagcggtgcaaagagaccctgataatgcaggccaacaccatctgtaaccaagccatagggccacacgcacagtcctgtctccacctcaccttatttcgactgtagcggacggtaccctttcgggtatcttctgagacgaggtctgtaaatatccagccaaccttaaaaaaaggaaagtagcttttaaacatctcctcaagatagacgatgaatggctgggcgcagtgactcacgcctataatcacagcactttgagaggccgaggcaggagaatcacgaggttaagagatcgagaccatcctggccaatacagtgaaaccccatctctactaaaaatacagaaattaggccgggtgcggtggctcacgcctgtaatcccagcactttgggaggccgaggcgggtggatcacccgaggtcgggagttcgagaccagcctgaccaacatggagaaaccctgtctctactaaaaatacaaaattagttggggtggtggcgcatgcctgtaatcccagctactcaggaggctgaggcaggagaatcacttgaacccgggaggcagaggttgcagtgtgccaggatcgcgccattgcactccagcctgggcaacaagaatgaaactccatctcaaaaaaaaaaaaaaaaaattagctgggcgtggccgggtgtggtggctcacgcctgtaattccaacacttcgggaggccaagacggtggatcacgaggtcaggagatcaagaccatcctggctaacatggtgaaatcccgtctctactaaaaatagaaaaaaattagccgggcgtggtggcgggtgcctgtagtcccagctactcaggaggctgaggcaggagaatggtgtgaacccgggaggtgaagcttgcagtgagccgagattgcgtcactgcactccagcctggcccacagagcaagactctgtctcaaaaaaaaaaaaaaaaaaaaagatagatgatgaatgttttctggcttctgcccagagagcttaaaaagaatgttctcagtcagaaactcctttttgtgagccaggtgaatctacatcaacaggttcctcaagtaagatgccaggccacacccagggatctccatctctgttcagtagaaactggccaccctccctctggtgctgctgggttagagatgagtttcctcagcaccagctctgcccagcaccatgctgggtgcaagagacacagcagtgagtgagaccaacagaaggtgagtgaaaaaggcacttaaactcccaagaggaagacagacaacaagcaagcaaataaacatttcagagagtaggtctttcctgacaagctaagaaaaaggattcctagagaaaggcacataatacaaaaggggtaatataatgcagacttcacacagctgctcctgggagctccacctcaaggccggaaggaagcatctgagggtatgaggatctgaaacctgtgacccagcaacccctgcacgttcagtgtagcagtgcctgtgtgctgtgtgatccttaggcccgcctctgcctgtgaattcctgcaccagaagcccgtcacgaggccacaggagcagcagttgagtcccggcaattgtcacttctgtcctcgggaaggatctgcggcccatgaccctctccagcactacctgacacacaactcttcccatccacccccagcagacatgactagcccactgggagactttcactgtctttaaagatgccccaatgaatgaaaaacccaaggtggtggcaacagagaaaatgaaacttaaagggttaattatgcagtaaataaagcaaaatcaaaatcaaactgagaaaaattagggcttagaaactcatattttaggccaggcacggtggctcacgcccataatcccagaactttgggagaccaaggcgggtggatcacctgaggtcgagagttcaagaccagcctggccaacatggtgaaacatcgtctctattaaaaatacaaaaattaactgggcgttgtggcgggtgcctgtaatcccagctacttgggaggctgaggcaggagaatcacttgaacccgggaggcagaggttgcagtgagccaagatcgtgccactgcactccagcctgggtgaaagagcaagactcctcaaaaaaaaaaaataaaataaaataaaaagagaaacttgtgtcttgcagaaaattatttaagtaatttcaagattatgaactgtaagattataacaaattaggtcaaaaaattggaccaatctcttttaaacaagagaacttccagaatttgaacccaaatatgcccctaaatcaagatgctgactccttgttagaaacaggatgtttctttcctaaagacagtaaaactgtgtggactgctcactgacactactaggttttaagtcacatttgcagtctcacccgcttcatctgtagagaagattaaataatctagagattatttttcatggtctgagttgattaggaaataaaggataaaacatacttattaacattaaactcgtaagatatgttcaaattcatggctctacattaatttattaaaattgttcctgggaactgtatcaatgtcagataaaccagatcaatagaataaaaaaggaaatccttttctcatcttctaactgttccatgaaactaggaagaattgtaggctcagagagctaaattataaacaggaaattaaatgatgattgatgacggagcagcagaagctccaagtgcatggcacagaacatgaacactgtcaatggaatgtcagccttgactgtcctcggcttccaagctacatgaagggagagctcaggcagaagggacacacatgcacagaggagccagcaggggtgcggctggggtctgtttcccacttgaagcagtcctcatgaagtgtggctggaaggctgaaatataacagccagatctgcactgggatttttttttttttatgctcaagaaaatgttctcattttagtttaagtcagaggaacataaaggttattggtgcccaacaaacatatgtgaagtttcaaaacatatagtgcctgcacctgaccttgtgcagccggagagagccagtacccgacacagcccggccactctcccaactccccctggcctggatgcccaacagagcctggccacgccccctgcttggctgccggatgcctcagtaccttccgcaggccaagtttggcagcaatttcatcgaccacttcagcttttggatcctcaagaagctccaagctgttctgtgtaccaatctgcagggaatcaaagggagaagatggacttagagcagagggctcaggaagcagcaccccaagcccttccacttccagctctaggtcacaaggagtgctgggggcctccttgtcagaaaggagaactatagccacagataaaacacatgcgacacgcctcccggcttctctccttctcgggttgtgctgcaccttttaccagggctgcaaaacatgtggcatgcagggcccagctgatgtgtgctgcacagctctgcatcaggagcactcaggactaaggcaaggcaaggtctacacactctgcctgttttaaaagttccttcatcagggaattaagttactttcaaacttccttggataagtagcttcactccaaacaggtttggctaaattaggcaagactcaaactgtaaggtaacatccattcccacaaaacagccttggaaaatctgtgtgccactcctgcagagacaatgcttggcttcacagctaagatactcagttacagggacactatgaactccacagagagcgatgagctcaccaaccctaaggaagggaaaaggtgttcaaaaatcaaccacctcctttcatctggcacagggcagtcgatgagttgtagcttcgactggctcccatgcaactgaaaccaaccacagcacatcacttcccagagtggaccaagcttaccgaaatcattaatgttcacttaaatgtagcttgcgggtcattcaaaggtatcattctatgcagaaaccccagccataagaataggaaaggtaaaggtaatctcaaattgagttacagtaactgggcatatccttgtaaattagtgaaaatctggcaaaccacaaagaagtttacgtttgctgggtattacccatatggaggtcattaatacctccagaacgtaggttaaatcacaaactcagagaaaaagctaaggaaaaggagttgtttaatgacatgtggcagcataagctgcataagcaaatttttgtgtgtgtatttttagtagaaacggggttttgccatgtcagccaggctagtcttgaactcctggcctcaagtgatctgccttgcccctacaaagtgctgggattatagatgtgagccaccacggctggcctcaattatacttttaatagaaccgttgagctctccatgaaagagaccctttaaaaaaactgaatctgaatactgtgtgcttcgaaaagcagcatcctgagtacagcacagtgacctaagggttgagacttcactggcggggtctctactgccatctagtgtctctttttaaaagaaccatggcaaaggcctcatgaaacactacatctattgctatacaaagataccaaaaatgtcactgaaaatccgtataaatacagccaagaaagacacacatttgtgcaggggccactagcaagcctgtacaccagctgttacccatgcatagcctgcagtttcagactctgatcagcaaactctgaaagcagctgcagggcaccccagcctgcctcccaggcaggttatctaaataggaggctagccatccggtgatctccacaagacagtgttaggtggaaaaagtgcacatattatacgtacaaagaaacaaagaagggggatagtatgaatgtgcgtgcatgcatgcgtgtgtgtatgtgcttacactaaaaatgtcacatacaaaaaaaacaaaactagccaggctcagtggcatacaccgatagtcccagctacttgggagaaagaggtaagaggatctcgctcaggagcgagaccttgtttcaaaacaaaacaaaacaaacaaacaaacaaacaaaaaacaaacttttgccaagcacaatggcttatgctggtaattctagtactttaggaggccaaggcagtaggatcacttgaggccaggagtttgagaccagcgtgggccacacagagaccctccctgtataaaaaaaaaaattaaacaattaaacaattaaaaaaaaatcaggccgggcgcagtggctcacgcctataatcccaacactttgtgaggctgaggcgggtggatcacgaggtcaggagtttgagaccagcctgaccaacatggtgaaaccctgtctctactaaaattacaaaaattagccaggcgtggtggcggcacctgtaatcccagctattcaggaggctgaggcaggagaatcacttgaacccggaaggcggaggttgaagtgagtggagatcatgccactgcactccagcctgggtgacagagtaaaactccgtctcaaaattaaaaaaaaaaaaaaaaatcaaacttcaggaagtccaactaaaaagatttaggctgagcatggtggcttatgcttgtaatcccagaattttggtaggctgaggcgagtgaactgtgtgagcccaggagttccagacaagcctgggtaacatggcgagatctgtctccacacacactatatatgtatatacacatacatacatatatatgtatatatacacacacacatatatatatacacacacatatatatacacacatatatatacacaaatacacacacacacacacacacacacacacacacacacatataaaagtcagacatggtggtgcacgcctgtagtcccagacacttgggaggctgaggcaggaggattgcttgagcccaagagggctgcaattgaggctgcattgagccatgatggcagtactgcactccagcctgagcaacagagtgagacgctgtctcaaaaagaaaaaggttttaaattctaggggctacctataaaggaaagcagggtaaaaggaaatgaatataccttgtttgtaaacatgactttggaaatgtgcactttttttttcttttctaacttttaaaaatatttctggctgggcacagtggctcctacctgtaatctcaacacttcaggaggccaagatgtgagggtcacttgaggccagtagttcaagaccaacctgggcaatatagcgagaccctgactctaccaaaaatttaaaaactagcttggcatggtggcatgcacctgtagtcccagctactcagaaggctgaggcaggaggatcgcttgagcccaggaggtcaaggatgcagtaagctatgactgcacaactgcactccagtctgggcaacagagcaagactcatctctaaaaaataaataaataaaaattaaaaatttctaacatacagctaatttaaagaattttacagtgaatactcatatacccaccactagattcaccatgaacatttcctatgcactatctgtccctctagtcacccatcaattcattttatttttctattggatttcaagtgtattacagacataaatgtacttctccctaaatagtacagcatgcatatcattaactagcattcaatatttgcttacttttttacttttgcaataaaatgtatgtaaaatacactacatcattatacataattacaaaacaaattgaaatttatataaatatacacacacagcccaattcccaaaaaccagaaatacaatgtgtaactagttggtggcataatcataccgagagggccttccaatgacttccaagcacagtgactagatgtgcacacaccctgcgggatataccctcaggacacttctttcccctccaaacaaatcttaaattgttatcagtcctattttggtggcagtttttgttactctggtgacactctggtgattggtgctgaggtgtgtctgtggccttctccatggttcctaagacagtgactgctgcatggtggaagagacacagaatgacacaaggactgagcacctggacactacagagtcaatgagcaaacctggacacagcagacgagataaaaacactggatcaatagtggcaaatgtaccggttgtgtaagaaaatatccttatccttagtaacatacactgaaggttttaggagccatgatctcactctccaataactcagaaaatgttgtgcacgtgcaccggtgtgtgacaaagggggaacaaacaacaaagcgaacagggcaaggcctctccgaaagggcgtcccccacagcctccaaacacagaaactcaggaacttgaatcccgtcatgtttacctgaggtggctcataaatcgcagccacttcagccctgatgccaaggggaatgtctttgtgctccgtgtaccgtccgtataagtacccaaaatgctggttccctgtctttctccagaagtcaagaaagcggtcagcgacggtgtgattctcaaacatgatattgtccacatgcctgtacttctgtagagttaacaagagtgggctgatgaaaacatgccatcaaaaagaaatcacttgtttttctaacacaaaccattcataaatatcttttacctagttctttaaaaaacaaaccaatagggtgtgatggtgcatgcctgtggtcccagatactcaggaggccgaggctagaggatcgcttaagcccaggagttcaagtccagcctgggtgacagagtgagaccccttgtatcttaaaaaataaacatctgggctgggcgcagtggctcacgcctgtaatcccagcactttgggaggccaaggcgggcggatcatgaggtcaggagatcaagaccatcctgaccaacatgatgaaatcccgtctctattttttttgtattttataaaaatacaaaaaattagccagagccaggcgtggtggcgggcgcctgtagtctcagttactcgggaggctgaggcaggagaatggcgtgaacccgggaggtggagctcgcagtgagctgagatggcgccactgcactccagcctgggcgacagagcaaaactccatctcaaaaaaaaaaaataaataataataataataatctgctattctatttaaaaataaaaacaataaacattacttaagaaaaaaaccagtcaggcacggtggctcatgcctgtaatcccagcactatgggaggtgaggcaggcggatctcttgagtccaggagttaaacctcaaaaattattcaatacagtgaaaccctgtctctactaaaaatacaaaaattagccaggcatggtggctcatgcctgtaatcccagctactccggaggctgaggcaatagaatcacttgcacctgggaggctgaggttgcagtgagccaagactgcaccactgcaattcagcctgggctacggagtgagactctgtctcaaaaaaaaaaaaaattgctctgccctttagaccacttcagagtccagtggcgggacacggggttataggaggatggagatgggtttcatctatcaataaattcaaaataattccattgtgatttaacctaaaatacaggttttcacaatctctagggcaaaaaacaaacattttctttttttttttttttgagacggagtctcgctctgtcacccaggctggagtgcagtggcgtgattttggctcactgcaacctctgccttcaggttcaagtgattctcctgcctcagcctcctgagcaactgggacgacaggcgcccatcactacgcccagctaattttttgtatttttagtagagatggggtttcaccatattggccaggctggtcttgaactcctgacctcaggtgatccgcccacctcaacctcccaaagtgctgggattacaggtgtgagccaccttgcccggccaaaataaagtagttttcaagaagaaaaaaggaatagagaataggaggtttccaaaaaagtcgaggaggccacggaattctctctaaggagccggccgttttctctaagggcacagcggcaggaggaaggcgaggcaggctactcagaggcgggacaaggacagcagaacatccagaaaggccggaacgctccctccttcctgagccacattctctccttaagccagcctggacaggtgctcagagctggtccaaggggtgcccctttaccaaccttcagagccagtttcctcacaaccactgaggattttaaataatcatcaggaacattctgcctccatatgagccagcaaaacagagaactgagggcgcgcactccatatctccaagagcaagaagccttaaaaatgatatattcagtgtaccacttccacaaaaggatcattcagtccatcaaaaagtactgaaaatccaccacgcatagtgctaatagcattccactccaaggggctcttctggaaatatccgtttctcagccatgaaaacaaatctagacagacagggaacatctcacctgtctgttcagcgtgatggcgctcggctggcacttagtacagatgccattcggccacgggaggtgcccctcgcaccctgacttaatcttgcagctgatgttctccagggcaacaaacttccccctacatagaagagaagcaacttaaacatcacattggtgaaaagttgagcaagaggctggaaatgacatgctaagtatcttatacctcctgaacagtgtctcaggagctaagcacgtggcagcagcagggaagatgggctaaggatgattctaatggaagctctacctacagttccagcacattccgaatcccagcttctgtcccacatacttcaaccatacaggaacacacaactactttcctaccaaactgtggtgttttttaccatctatcactaacatccgagaaagctttcaagaatactgtagaatatctactgatctcacctgtgccactgagcgggcatgaggctcctacaggtttcattaaattgtcagaaactttgacattagcccagtacttagatatttgtaaaaaattcttattcatgggaaaaatctgattaggatatataattaaggcatctttactctgctttaggctaaaataaaaactactgttgaagactgtcaatgagaaaatcctggaccctactctgaactttttctttttctccagctttattgaaatataactgacaaaaaaaaaaaaaaaagaaatctgtatctttaaggtagacgtgaggttttgtttttcaaataaaaacgatatatttacagtgtacgaaatgatattctgaaacatgtccacactgtggaacggctaaattgagctaattaacatatgcattacctcacatactgatcatttttggtggtgagccatttttggtatcatagcatctaggaagcaaagactcgtcactgaatctgcatgctaacagcagccacaaacacgcccccactagagactgtgttccttgacctagactgagaaaggctgaccaagtctctttcactacaatcaatctgcacccactccttagtccagagagttccacagctttccccactgacaagcaacagtgggtttctagcaggttttttcttctggtctaacatttttaaaaagtcattttaggatgtcagcaggttgtcagagaaaagctacaatcaggcgaatatgacatccttcacaaaatgttgctgacttcagttcagccaccatctcctcgttgcactgacaggaattataaaataatagctgaagcctgctactttctggtagggtgtacagagagccaacaggagaaggtcatacaggcaagggcttgccatggcttaaaagaaatcaaaatgctcagttcacccctttctggccactgttaccacctctgcccacctggctgagcctgtgggcaactactgtggtaccatgaggattagtggctgcagcccctgctgtggctgaaaaccaagctgactcagaggccaggctctggggaaagggttaccaggcactgaggtggggaagctgagattctcacagggtagttgtttttctgaaaagcagagaatgaactcagaccacagaatcaacaggccaccatcacagatgctaacttgctggggtggtgtgtgtggggacagcctctgtctgatactgcactgtggccacgcagccaggcgcctgcacagtcgctctgccttgctagctcccttctagaaccaggttggccaggcgaggtggctcacacctgtaatccagcactttggggaaaccaaggcaggaggatcacttgagccaaggagttctagaccagcctgggcaacatagtgagaccccatctcttaaaaacatatatgagtacataaaaaataaataaataaatatagaaccacggtaactttcaaaggcgtgtgaccccttctcatctttacttctctcattcacacgttcactggctataagcaacaactgccagctacacaaaaaggaatttacgcacaaccaggttacagcaagttgcttacttgtcagcccctccagtcagcttccggatgtaggcgtggaaggacatgtgcttcacgggaggctcgagatggtttagatagtcctcatcgaatggctgccaagacacagagtaagcgagtgcagtctcacacgtgccggtcactccaggcgctgagcctctgctacgcacagggggaggccagcagcatggccttggcaagtcaaggcccacagtgaaagcaggtactagggtctcccttaccactctgagtcagaaccaagtttttctttttttaattaattgttttttgtttgtttgttttgagacggagtctcactctgtcgcccaggctggagtgcagtggcacagtggcacagtctctgctcactacaacctccacctctgggttcaagcaactcttctgcctctgcctcccaagtagctaggactacaggtgcacgccaccacgcccagcttatttttgtatttttagtggagacggggtttcagcatattggccaggctggtctcaaactcctgacctcatgatccacccgccttggcctcccaaagtgttagctttacaggcgtgagccactgagtctggccaatttaactgttttagagatggggtctcatgctgttgcccaggttggagtatggtggtgcaatcatggctcactgcagcctcgacctcaagtgattctcttgcctcagcttcctgagtagctgggactacaggcgtgaaccaccacacccagctaattttttaaattttttgtagagacagggtatacaaaaaaagagttgcccaggctgaacaattcctaggctcaaatgatcctctggccctggcctcccaaagtgtcgggactacaggcgtcactgcacatagccagaagcaagtttttctttgtgtgccagttatcttttcaagattaaaatgaatctctattaaacacaaaacgctctaagtcaaatgagtttcaggaaaattgtgcaaaaagaaatgccacaagatgaggcaagagatgcctcatgaagaaaatcgggctggccttcctgctgtaaacccagcattaacagttccagtcggcattattacggtaactctcagtctcaccaggacaaaccagtagaagagatgtgagattcaaggcaaagtaaatcaacaatgataagcacggaggccgacaggctcagctttgtgtcagatcggaaaaggattgtccagggagcccgctgtaaatgctgcccctttatcacagccacacaaatgcttcagccattcataatccagcgagaaggtcactcccataaataaaggctcgtcctgtgtgcagcttgcactaggggaatatgaggcccagggcaataaataggtaagttctttgaaccactcactacagccaagtgcgtggactcagggcaagcacttaagacagctgtctacccgcagccccccacactggcccagaacttactccgcagagactctcacctctagagggacgcagtgcacgcatttccccaaagggccgtggcggcatctgaggagagtacaaggcagaaaaaggcagagcagtgaggatgtctgtgttccgctgctgctgtctcacatgcacgtcctactttaacagagtgtttccctgcccacgtggagttatattccagatggcacatggataaacatttatattttaattgttgttttgttttgtttaaagacaggctctcactctatcgcccaggctggagtgcagtggtgatcgtggctccctgcagccttcacctcctgggctcaagcactcccacctcagcctccccgagtatctgggactccaggtgtacaccaccacacccagaagtttactacttatgttgatatgaattagaaaaaactgacccgcacatcaaacctgtgacttcatgggtatccactgcttaaaatgacacaaaccaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaatgacacaaaccaaagataaaagtgaatgaactcaaagtcaatgtaagtagtttattggccaaaggcagtggctcacacctctaatcccaacactttgggaggctgagatgggtggatcacctgaggtcaggagttaaagacaagcctggccaacatggtgaaaccccatctctactaaaaatacaaaaattagccggacgtggtggcaagcacctgtaatgccaggaaccagggaggctgaggcaggagaattgcttgaacctgggaggcaaaggttgcgatgagctgagattgtgccactgcactccagcctgggagacgagagtgaaattccactcaaataaataaataaataaaatagttttttttttgttttctttttttctgagacggagtttcactctgtcacccaggctggagtgcagaggtatgatctcggctccatgcaacctccgcctcctcgtttcaagcgattctcctgtctcagcctcccaagtagctgggactacaggtgcacaccaccatgcctggctaatttttgtatttttagtagagacgggatttcaccatattggtcaggctggtctcaaactcctgacctcaggtgatccacctgcctcagcctcccaaagtgctgggattacaggtgtgagcaactgcgcctggccaagtccatttaaagaaaagtgttaaataggccaggtgtggtggcttgcgccctgtaatcccagcactttgggaggccgaggcgggtggatcacaagtcaggagatagagaccatcctggcaaacacggtgaaaccccgtctttactaaaaatacaaaaaaattagccaggcgtggtggcgggcgcctgtagtcccagctacttgggaggctgaggcaggagaatggcgtgaaccggggggacgcagctggcagtgagcggacgtcgcgccactgcactccagcctgggtgacagagcgagagtccatctcaaaaaaaaaaaaaaaaagaaaagtgttaaataaataataacaaagctggtacgtgaacatggcaaagggcctgagagcggtgcataaataatccaagtttggaaaatacctacttcatatgcattttgggaaataacaacaatgaaaaaaccttgtcccacggctttctaacattttcagtcacagaagccttgggagcacaacacgcacaatctgaaggagaggtatgctggtttacgagggcgccggcggccgtccctccggggctcagtcagacccctttctaagtggggtcagaattcttacatgcgtatgagccctgtgctgcggaacagaggtggcctctgtgcttcctaataggcaggatctaagtgatgatggctcagaattctctcacacacacacgctctcaaaagctgctaatgaagccatgaagacacagatcatgcaagcaagccagtgccaggcccctgggaggagacacaaatggaagaggcatgccggctaatggctatggctacaaagtggctccatgccaatggcaggagagcaccatttatggctctctgatctaagacataaaagttgctaatgcagcatttggaatcccaatacctcaaagtcagcaccccgtcacatctacagagtgatgcattttaaaaaagaccccactgcagagacaaccttcgctcagacaatttcacatggccaagtataaactcagatccttctcactggtttatttaaaaggaattgcaaaaaatctaaaataaacaaatgtacatatgcataagcacttcatatagccccaggtgaggagggaatattccaaggcacagcatcttctgcaagtgaaatgcttgctgcagggatggagagcgcacactagcgtggcaggtcaaaatcatccaaccgctatgaaatgagagacacagcactcacctcacatggatgcgcacacacaaccacctgccccttccctcctccctcccctgcagctgctgattaacaccccactctgcacgggaatcagcatctccaggggacatcacagtaaagacttggtgtgaggcccccaactcccccaatacctttccagtctctttgtacccaaatgcttcaaaattttttatgggaacatattttgaggtggaaactgataaaaagctaaaaaaaaaaaaaaacaaaaactgataaaaagctaacaagataacttgaagtttaatctgaagatagtaaaacttaagacttaacatttcttcatcagatacttattaaaacaagacatgttataaatatttccctttattcacccattaagatcaccacaagtaggaccctggaatctcatggatcacttacagctgtgggtctcggcttctgtaaatcttcccgtcctgtttgctgaggtactgatcaatctcatcctccaccacgttgggagcgccaaagactttgaagcccggtggaactgacgtctccatttcagatgagggcccagcaaggctcgagggaaacaggaacaacaaatcgccatgcctgttcaaatgataaacagaggctgatgccttcccttaccacctgagcttcatggaagcccaacttggatatctgcaaaaagcaaatgccaaccacccctgtaggcctaaacaatgaggtttctaacttttaagatgagaattctcttctaacatctcccctatgtttcctggcattataaagaccagtatgcaggttctctgtaatttaatctcttacaactttaccttaaactctgtgaagcctccatacacccaaatgattttgcttgcacacacagccacaatggacctgctgggtttcagggcctctcctcccgcctctcaccctctgcttggcccccacctccctcagccattcctctggcctctgggaggctctctcctcccccaacactgcatgtgctggttgcatgtatctccactgctttctcggcgttcacatacacacgtaagcacagacacgcataggagctgtcactgcttttaaaaagtgtgactggccaggctcggtggctcatgcctgtaatcccagcactttgggaggctgaggcagatggatcacaaggtcaaaagatcaagaccatcctggccaacagggtgaaatctcgtctctattaaaaatacaaaaagactagctgggcgtggtggcgcacgcctgtagtcccagctactcgggaggctgaggcaggagaatcacttgaacccaggaggcggaggttacagtgagccaagatcacaccactgcactccagcctggtgacagagggaggctccatctcaaaaaaaaaaaaaaaaaaaaaaaaaaaagtgggattaccagagacatacttttctatttcaacaacccctcataaaatcctccaaatataaggagtccacgtctaattgctatgacaatggctgcctcaattccccagtgaggctgcttaaccaccccctcagccactcctcccacaatgacaagtatgcacaccatctgccagcttctgccatcatcaccaccacccaaaaaggcccacggacagacgtccctgtggttttccttctaaagggcaaattcccaggagtcagacttaagggtactgctttccaaaaaggttgccacaagtcacatctggttttctatcactttcagtctgaagtgtgttcttcccttggtcagagtcacgctgccaacttggtgccaggtttgactggcatggcaaactgctgacctcagaggctaacaagcatctccactcacagtccacagaagccgcctggggtcccaagtgaccagagatggctgccaacactaaccctccaggccagccttggaagaaaggctgcagcatgtcctctgacagatatctaactgctgccaacaagacacacacacaggggacagactgagagggcaggatccacagctctaaaccaacacggtgaaggaagagcagaggccaaagtgcaggccctcaaggacacacagacactggggctcaggtgcagctcttcaactaatttctttcctcctcctcttcctccctaatttgggggtgatgaacattaccaaacattaccacatcagagacgtctgtttctttctttttttttttttttttttgagacagagtcttgctctgtcacccaggctggagtgcagtggcgtgatcttggctcactggaacctgcatctcacgggtttaagcgattctcctgcctcagcctcccaagtagctgggattacagacatgtgccaccacgcccagatactttttgtatttttaatagagacggggtttctccatgttggacaggctggtctcgaactcctgacctcaggtgatccacctgcctcggcctcccaaagtgctaggattacagtcgtgagccaccacgtccagccgagacgtctgtttctaatagcagattacatattcctaaacaccatctaactactaatataaaaaacttgacttacacacaagatcaattttaacaaatatactctaaaatcaattgatgagctctaaagaaagtagaggaaatccccaggggacaaacccagcagtgcactcagacagcagccagcaacacagaactcagagctgcttgtggggccaaggccactctcagtaattcactcacagctttgggcctacagcggtttgctgggcactgggagacaagaacttgggcttccctgcccagagggggcagctgagtccgaaacttccacataaatgcagataaccaaaggacgcctgaacagctgtgaaaaacccaccagctgaaaataggaaccaaggaggaatcccatctgcctctatccagtacacagcaaaaaaaaccaacaaagtcacctctgagactctgtaactaaaggcctgctgggccatgcatctggagcagaaccagggatgatgccatttggttcagaaagcccaaagacagaaattaactcaaaggagttgtaggtccatcacacccccctgtgccaacaaaagcaaatgcaaacctctgtagaaaagctgctaaatctgggccgggcgtggtggctcacgcctgtaatcccagcactttgggaggctgaggtgggaggatcacgaggtcaagagattgagaccatcctggccagcacagtgaaacctcgtctctgctaaaaataaaaaaaaaaattagccgggggtggtggcgggcacctgtaatcccagctactcaggaggctgagacaggagaatggcatgaacccaggaggcggagcttgcagtgagctgagatcgcaccactgcactccagcctgggcgacatagcaagactccgtctcaaaaaaaaaaaaaaaaaaaaagaaacaaaaagaaaagaaaagctgctaaatctggatccttcaggattcctcaagaccaagtttggtcaaatataacctgtcataagaaccaaaaatccaaatgtagaagagtaacacacgggccaggcacagtggctcacacctgtaatcccagcacgttgggaggccgaggcgggaggatcatgaggtcaggagattgagacgatcctggctaacacggtgaaaccccgtctctactaaaaatagaaaaaattagccgggcatggtggcaggtgcctgtagtcccagctactcgggaggctgaggcaggagaatggggtgaacccagggggcggagcttgcagtgagccaagatggtgccactgccctccagcctgggcgacagagcaagactccatctcaaaaaaaaaaagagtaacacactaccacgcaagtaagagtgggcagagacataattaacagagagttagactgccaaagactcacacacagaaattatgagaccgaatatcaacctctacatgggatattaaatgaacaatggaatggaagaagagggtgagtgacagaggctatccaaaatgaccaggtgggattctaggacatggaagtggcaggcaccaaagtcagtggctcttcccaaatctccctcctgcaggcagctagaccgcatgccaggtcccacggatgcatctacagcaatgcagggggcagggatacaagtgggggcagacagatgccaacagtcacgagacccaagaggcaggcccccatgtctcacagcccggatagggagtcctcaaccacccagtggtcttcactggaggccagtgggccaatgtggcagcagagcagaaactaggagaaaccaggagccacatggcccctgtgagtacttgaagccaacagacagatttaggggaaaaaaaaatcagattatgtatttatttatatacttttgagacagggtcttgctctgttgcccagctgcagtgcagtggcacaatcacagttcacaacagtgtggacaaagaccctgtctctaaagaaaaaaagagggtgccaggtgtagtggctcactcctgtaatcccagcactctgggaggctgaggccagcagatcacctgaggttaggagttcaagactagcctgaccaacacagagaaaccccaagtctacttaaaaatacaaaattaggccgggcacagtggctcatgcctgtaatcccagcactttgggaggctgaagcaggtggatcacaaggtcgggagatcgagaccatcctggctaacacggtgagatcccgtctctattaaaaacacaaaaaatgcccccctccccctccccctccccctccgtctctttccacggtctccctctcatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagatggggtttcgctgtgttggccgggctggtctccagctcctaaccaagtgatccgccagcctcggcctcccgaggtgccgggattgcagacggagtctcgttcactcagtgctcaatggtgcccaggctggagtgcagtggcgtgatctcggctcgctacaacctctacctcccagccgcctgccttggcctcccaaagtgccgagactgcagcctctgcccggccgccaccccgtctgggaagtgaggagcctctctgcctggccgcccatcgtctgggatgtgacgagcccctctgcctggctgcccagtctggaaagtgaggagcgtctctgcccggccgccatcccatctaggaagtgaggagcgcctctttccggccgccatcccatctaggaagtgaggagtgtctctgcccggccgcccatcgtctgagatgtggggagcgcctctgccccgccgccccgtctgggatgtgaggagcgcctctgcctggccgcgaccccgtctgggaggtgaggagcgtctctgcctggccgccccgtctgagaagtgaggagcccctccgccccgcagccgccccgtctgggaagtgaggagcgtctccgcctggcagccgccccgtccgggaggaaggtgggggggtgagcgaccccgcccggccagccgccccgtccgggagggaggtgaggggtcagccccccgcccagccagccgcccgtctgggaggtgaggggcgcctctgcccagccgcccctactgggaagtgaggagcccctctgcccggccaccaccccgtctgggaggtgtacccaacagctcattgagaacgggccatgatgacaatggcggttttgtggaatagaaaagggggaaaggtggggaaaagattgagaaatcggatggttgctgtatctgtgtagaaggaagtagacatgggagacttttcattttgttctgtactaagaaaaattcttctgccttgggatcctgttgatctatgaccttaccccaaccctgtgctctctgaaacatgtgctgtgtccactcagggttaaatggattaagggcggtgcaagatgtgctttgttaaacagatgcttgaaggcagcatgctggttaagagtcatcaccactccctaatctcaagtacccagggacacaaacactgcggaaggccgcagggtcctctgcctaggaaaaccagagacctttgttcacttgtttggctgctgaccttccctccactattgtcctatgaccctgccaaatccccctctgcgagaaacacccaagaatgatcaattaaaaaaaaaaaaaaaacacaaaaaattagccgggcatgttggcgggcgcctgtagtcccagctattcgggaggctgaggcaggagaatggcatgaacccgggaggtggagcttgcagtgagctgaaatcgcgccactggactctagcctgggcaacacagtgagactccgtctcaaaaaacaaaaacaaaaacaaaattagccgggcgtggtggcacatgcctgtaatcccagctactcgggaggctaaggcaggagaatcgcttgaacccgggggggcagaggttgtggtgagctgagaccatgccactgcactctagcctgggcaacaagaatgaaactctgtctcaagaaaaaaaaaaaaaaaagaaagaaaagaaaagaaaaaaggcggggtgccaggcgcagtggcttacatctgtaatgccaacactttgggaggctgaggcgggtgaatcacttgaggtcaagagattgagatcagcctggccaacacggtgaaaccctgtctctactaaaaatacaaaaattacctgggaatggtggtgggcacctgtaatcccagctactcaggaggctgaggcaggagaatcgcttgaacctgggaggcagaggttgcagtgagctgagatcgcgccactgcactccagcctgggcaacagattgagactccgtctcaaaaaaaaaaaaaaggtgggggtacagcaccccatggtcctgctgagggaatggcctgagtctgtcaggcctctgtttaccgctttgcatcggcaggaaatccaggacacagagggtcatgctggagggtcttgtgaatgtgaaatcagcaagacctcagaggtgggaaactctacaggtcaatggaccaagttcctcaacagataaatttcaagaaaaggaaagagatggaaggggaacctgaagattacaagaagtaagacatacaaatttccttaaaaagcaagactaactggcagtgtctagggatagacactcaagtaacgaaagaataaagagccaggcacggtggctcacacctgtaatcccagcactttggaaggccaaggcgggtggatcacgaggtcaggaattcgagaccagcttggccaacttagtgaaaccccacctctacataaaataaaaaaattagccaggcatggtggcacgagcctatagtcccagctactcaggaggctgaggcaggagaaatgcttgaacccgggaggcagaggttgcagtgagctgggatcacgtcattgcactccagcctgggcgacagagcgagactccgtctcaaaaaaaataaataaataaaaaaatgcaaaccggtgattactgttagggaagcttctgcagtggctgccaatgccttatccccagacctgcttggtgcttgcaatggtgacacataaggttcatccatcaaggcatacactgttttctgaggtgttcagtacgtattttgtttaataattaaaaagaggagggagaaaaaaaggccaagcaacagaagagaaggaaggagggcaagagcagcgggacaagcgtggtcgtgagctgagagttcctctggctggaacagagagcgtgcactcacagtcattctctttacctttagataatggttacgtgttccagatttaaacttttttttaaaaaattaccagctagatttgatttaaaagtgaaaaatgtgcctgtagtcccagctactcgggaggctgaggctgaaggatcacttgagcccagaaggtcgaggctgcagtgagctacgatcgcaccaccgcactccagcctgggtgacacggtgagattctgtctcaagaaaaggaaagaaaggaaaaggaaaagaaaggaaggaaggaaggaagtatcaagatgcaaaacccttcaagaaagaaagaaaaggaaagaaggaaggaaggaaagaaaagaaaaaaaaaagaaaaatatcaagatgcaaaacccctcaccagctcaaaagaaggatgaaccagtgtcactctggaaatgaacatcaacaacaagaggtttcgtttcacctcaccacatgggtaggcaaacagtaggtgcccaataaatctttgttaagaacaaatgaatgctacaattgcatgttgtgtccctagacatagtaatttgtgaatctaaaagtgaccaagtgcaaaaccagcccatcattctggctggtaaacaggctcacagccaactgccagcaggtcccaggcccaccactgagccagcggccacagcacatgcaacctgcagcgtcgagaggaaaactggccactagctccttaaggactgaactgatctaaggcacatgtgagcaagtgcccagatggtttcgatgggagccagcacccgtgttccgtaaaggaccagtcaatactttcagctttgcaggcctcacggtctatcacaactaaactctgcccttgtaacatgaaaactggcaccaacaacacgacctggctgtgttccaataacactttacaaaaacaggcagtagccaggctgtgacaagaggtctctgagtcctgaaggtcctgaatgaccaactctacagggtggcatgggccactgcagtggcagcactcctacccaagccagcagggctaacatgatttcccggcacacagctgtgttcaaggtctttcactccagacaagcagctgagtatgcagctcactccacgccgtacatggacaaagacaataactttctcctcagtgacacaaattccagaattctgcaaagtcaatcaaatctgctcaatagtaactgcagattcaggataattactgaattcctggcaagcaacacggtcatgtgtattctggtcagttgataagaccataatgagtggtgtgatgaggaaagaggataaaactcggcaacctcgggcagatcatggggacctcatttccccccattccctgcttcctcctcagaggacacttacttgatttttagcaagttgagggatttgttggaggaggctgttatctctccagtcttgtttctattgatgtaaaccgagaagccattattttggaagccaaactcctttgcaacctaaaacaaggcccaaagaacagaaatttaatgaaatgctaaagtatcactacatataccatacacgccagacactactagaagagtattcaccaaatttggaaagtgcccatcatttaccaaattcctcttgctattttgctcttttaaagaaatttgtactgttcacaaaggtgtcaattaaaatgaataaagtggccaaaaaagcaaaggtcttgtcaatgatgaaactttgtaaaacatttaagactttgaagcaaacaagagttaatggctatccttgttttgttttcagacagtctcgttctgtagcccaagctggagtacagtggcatgatctcggcatactgcaacctccacatcccaggttccagtgattctcctgcctcagcctcccaagtagctgggattacaggcgcctgccaccacacccggctgatttttgtatttttagtagagatggagtttcaccatgttggccacggtggtctcaaactcctgacctcaggtgatccgcccaccttggcctcccaaagtactgggattacaggcgtgagccaccatgcatggccaatggctatgtttgaaaagttcaatttccatttttgaattcaattgtaaaaacccaattccaggccaggcgtggtggctcatgcctgtaatcccagcactttgggaggatgaggtgggagtatcacctgaggttaggagttcgagaccagcctgaccaacatggtgaatccccgtttctactaaaactacaaaattagccaggcatggtggcacatgcctgtaatcccagctacccgtgaggctgaagcaggagaatcacttgaagctgggaggcagaggttgcagggagccgagatcgtgctattccactccagcttgggcaacaagagcaaaactctggccgggtgtggaggctcacacctgtaatctcagcactatgggaggccaaagcaggtggatcacgaggccaggagttcgacaccagcctggtcaacatagtgaaaccgtctctactaaaaatacaaaaattagccaggcatggtggcgcacacctgtaatcccagctacccgggaggctgaggcagaactgcttgggcctgggaggtagaggctgcagtgagtcgagatcatgccactgcactccagcctgggtgacagagcaagactttgtttcaaaaaaaaaaaaaaaaaaaagcaaaactctgtctcaaaaaaataaaaaacccggccgggcgcggtggctgacgcctgtaatcccagcattttgggaggccgaggcaggcggatcatgaggtcaggagatcgagaccatcctggctaacacggtgaaaccccgtctctactaaaaatacaaaaaattagccgggcgtggtggtgggcgcctgcagtcccagctactcgggaggctgaggcaggagagtggcgtgaacccgggaggcggagcttgcagtgagccgagatcgcgccactgcactccagccaggacgacagagcgagactccgtctcaaaaaaaaaaacaaaactcaattccaattctgaaacctaacacagaatggtgcgactaaatcataaaacgtccactgtgcagggcactttgctagatgctgggaatattcactcattccttcaacaaatattaagcagttctatgtgctcagctccattctgggtgttcagatcacaaaaatgaactagaaaagacaaggtttctggccgggcgtggtggctcatgtctgcaatcccagcacttcgggaggccaaggcgggtggatcacttcaagtcaggagttcaagaccagcctgaccaacatggtgaaaccccatctctcctaaaaatacaaaaattaggccaggtgtggtgactcacgcctgtaatcccagcactctgggaggccgaggtgggcggatcacgaggtcaggagatcgaggccagcctggccaccttgatgaaaccccatttctactaaaatacaaaaattagctaggcgtggtggcggacacttgttatcccagctactcaggaggctgcggcaagagaattgcttgaaaccagaaggcagaggttgcagtgagccaagatggcgccattgcactccagcctgggcgacaagagtgaaactccgtctcaaaaaaacaaaaacaaaaacaaagacaaaaattagccaggcatggtggtgcacgcctacagtcccagctagtcggtgggctgagacaggagaatcacttcgacctgggaggcggagctgcagtgagatgagatcacgccattacactctagcctgggcaacggaacaagactccacctcaaaaaaagaaaaacaaaaaaaagacaaggttcctgctgtcaagcagtttaccaacaaatgggggagacaaagtcaacaaaggtcgaaataagcactacgacagaaaaggaaaagaaacctcagatgggaggctagaagtctctctgaagagcttcagctgagcagggcccacccagcggtgggtaagcccgccacacgcgagctgggagaaaaggccacagggagtaggagcaagcacaaagaccaggaggcaggaagggtgttggaaacacggaggccagaggccaataaacaataaggaagatggaaagagatgaggctggcgaggcagacagggccgtgggaagccacacagacgaaaggcagggggaatcatcatccacaaaatccctgttgctcaacaccacactgaagaggaagctagagtgccaattagagacaagagagatgggctgagacaggggatgagatgggacaggatggtggggatgaaggcaagagcacactttccagcagtggtcatcaccaggcccagctgacgagcaggaccaggggcaggaatggaatgagagaaaggaaggaggtcagagtaaagctgagaattctagattgagaaactatgtggaggtaacacctgtgcagggaccatgaaaggaaaggctaaaaaaggaagaagactagagggaaaatcaggacttccatttgacactgagatcggaggtgacaaccagacacactgcagtgaagccgtccagcaggcaggtgggcgcatctgtgtctgagcccaggcaaggggccagagcaagagctctacaccgaggggtcatcagagtagatgtacccaaataaaaggaatgtgaatctcggtaaagaaacaaatcataaaagaacaatcaaatggaaattctagaactgaaaaacacaagaacagaaataaaaaattcactgaacgggcttatcagcagaagggagagagcagaagagtcaacctaaacataggtgaatagcttgtggtcccagcaactcggaaggctgaggtggaagcactgcttgagcccagaagtttaaggctacaatgagatatgatcacaccactgcactccagcctgagcgacagagtgagaatccaaccaactctaaaaagaaaaacataaatgaatcaataaaaataacagctatataatctgaaggcagagatttggggaaaaaaaaaacagccttaggaacccatggtacaggatcaaatgctcctcactagaaaaaaatgagggttgggcgcggaggttcaagcctgtaatcccaacactttgggaggccgagttgggcagatcacctgaagtcaggagtttgagaccagcctggccaacatggtgaaatcccatctctactaaaaatacaaaaattagacaggtgtggtggtgcacccctgtaatcccagctactcaggaggctgaaacaggagaatcgcttgaacctgggaggtggaggttgcagtgggcagagattgcgccactgcactccagcccaagcgacagagtgagacttcatctcaaaaaaaaaaaaaaaaaattagccaggtgagctggcacgtgcctgtaatctcagttactcgggaggctgagccaggaaaaccgcttgaaccccggaggcggaggttgcagtcagccaagatcgcgccactgcactccagcctgggcaacagagcgagactccatctcaagaaaaaaaaaaaagaaaagaatgaaaatagaacagaaaaatacttaagagtggggaaaaccccaaaatttaatgaaaaacatcaaatagcaactccaggaagttcagcaaactctctcaagttaagatacaaagaacaccactgcaaggcacaccagagtcaccctactgaaagccagaggtcaacgaagacgagaagaccaagaagacggtggaacgacagcttcaaatgctcaacaggaccaggcaccgcggctcccgcctggaatcccagcatccaggagacagagtggggaggatcacttgaggaaatcaagaccagcctagacaacatggtgaaaccccatctctaccaaaaaattaagaaattagctaggaagctcacgtgggaggatcgtttgagcccgggaagtcaaggctgcagtgagctgtgactttgccagtgcactccaacctaggcaaaaataataataataataattttaaaatggactgggtgagggtggatcatacctgtaatcccagcactttgggaggctgaggcgggcggatcacctgagatcaggaattcgagaccagactggccaacatagtgaaacctcgtctctactaaaaatacaaaaatcagctgggcatggtggtgcgagcctgtagtcccagctactcgggaggctgaggcaacagaatcacttgaacccgggaggcggaggttgcagtgaggcaagattgtgccgctgcactccagcttgggcgacacaatgagacttcgtctcaaaaaaaaaaaagaaaaagggccaggtgtggtggctcactcttgtaatcccggcacattgggaggccgaggcaggcggatcatgaggtcaggagatcgagaccatcctcactaacacagtgaaaccccatctctactaaaaacacaaaaaacattagccgggcatggtggcgggtgcctgtagtcccagctactcgggaggctgaggcagggaaatggcatgaacctgggaggcagagcttgcagtgagccgagatcgcgccactgcattccagcctgggcaacagaaagactccgtctcaaaaaaaaaaaaaaattgatgcatggtggggaacaaaaatgaactgtcaactcagaaatctgttttgaggccaggtgcagtggctcacgcctgtaaccccagcactttgggaggccaaggcgggtggatcacctgaggtcaggagttcgagaccagcctgaccaacatggtgaaactccatctctattaaaaagacaaacttagccggacttggtggcgtatgcctgtaatcccagctactcggaaggctgaggcagaattgcttgaacccgggaggctgaggcaggagaattgcttgaacacaggaggcagaggctgcaatgagccaagatcatgccatcacactccagcctgggcaacaagagcgaaactctgtctcaaaaaacaaaaacaaaaattagccaggtattgtggtgcacacctgtaatcccagctacttgggaggctgaggcaggagaactgctggaacccaggaggcggaggttgcactgagccgagatcacgccaccacattccagcctgggcgacagaaaaagactccatctcaaaaaaagaaatttgtattgaatgaaaatatccttgggaggccaaggcgggcagatcacgaggtcaggagatgaagaccatcctggctaacatggtgaaatcccgtctctactaaaaatacaaaaaattagccaggcatggtggtgggcgcctgtagtccagctactcgggaggctgaggcaggagagtggcgtgaacccgggaggcggagcttgcagtgagccaagatcatgccactgcattccagccttggagacagagcgagactccctctcataaaaaaaaaaagaaaaaaaaaagaaaaagaaaatatatccttcatggctgggcacggtggctcacactgaagcgggtggatcacgaggtcgggagttcaagaccagcatggtgaagatagtgaaaccccgtctctactaaaaatacaaaaaattagtcaggtatggtggcgggtgcctgtaatcctagctactcgagaggcttaggcagaggattgcttgaacccaggaggcagaggttgcagtgagccgagatcatgccactgcactccagcctgggcaacagagtgagatgccatctcaaaaaaaaagaaaataaccctcatataaacacagggcaaaacgaaaacattttcaggtcaaaaaaacccaaaggtctgtgaccaacaaacctacctacaacaaaggctaatggatgtttttcagtctgaagagaaacaacaccagacagaaatagtctgggggaatccatgggaaaagtaaataaggaagaaactgtgaagataagctaagaagtacataatatgcaactatcacagtaaatgaaatattttgtgattggttaaaaaaagaaaaactgtcatgggaatcctggacacaatgcaggtcaggagaccagggaggagccagggatgattctttgagtcaactgtagtcatatctacaattcatacttttttttttttttgagacagtctcactctgtcgcccaggctggagtgcagtggcgcgatctcagctcactgcaagctccgcctcctgggttcacatcattctcctgcctcagcctcaccagcagctgggactacaggtgcccgccaccacacccggctaattttttgtatttttactagagatagggtttcaccatgttagccaggatggtctcaatctcctgaccttgtgatccgcccgcctcggcctcccaaagtgctgcgattacaggcgtcagccactgcgcctggccactcttatgaaatacttttttttttttttttttgagatggagtctcactctgttgcccaggttggagtgcagtggcaccacctcgactcactgtaaactctgccttctgagtcaagcaattctcttgcctcagcttcccaagtagctgggattacaggcacctaccaccacgcccgactaatttttgtatttttagtagacggggtttcaccatcttggccaggctggtcttgaactcctcacttcgtgatccacccgccttggtctcccgaagtgctgggattacaggtgtgagccaccacgcccagccgtgaaatatttttacacttacctttgggctcttggtcctataattttgagcagtgatcagctgtgacaaacatctcatcctatagcaatccaacccaactgtgatagagaaaggcaatgcaagaggcaatttgggaatagggaaaataagaaaacgaggaaaagagaaaaggtatcgatggcagtaagagtagaggatgaaaaatatcctgagggtcaatacccaggccacagatacctttttcaaaaatgttgctgctgtttctctctttgttgctgtgatccgcttcactccatccggggactggacacgaattatctgttgcaaacaaaacatgatggttactgcacagcctagtgaggtcctgatctaatactacggcttccatctgtggtcttttagcatctgggtcactgaaaattaaagccaaacctcactcttcacctttcaatacccagctcaatccttctagaatatgatgccgaggggtgagattcatcaacatatggggagatattttaagagtactgtcctctcaactcttagtttcactcagaaaacaactttaattcctaatcactatttatagagtatatgtaaaacactttttgtctcttcagacttaaaacagagaaaaacccaccatgaaccatgaatgaactgtgttctttaaaaaagatgttactttggggaaaaaaaaaaaaaaaagatgttactttgttccaggatctatatacaaacattagacagtcttcaagagtcctacaatttaaaagaatcacaggaaattttctaattgttactttttttttgcttttttgagacagggtcttgctgtcacccaggctggagtgcagtggcaaaatcacagcttactgcagccttgacatccaaggttcaagtgatcctctgacctcagcctcccgagagctggaaccacaggcttgcaccaccacaccaggttaatttttttttttgtagtgacggagtgtcatatttcccaggctgatctcgagctccggggctcaagtgatcctgccactgtgctgggattacaggtgtgagccacaacgccagctattacttactttccctaaaaaacgtttaaaaatggccagacacagtggctcacgtctgtaattgtagcactttgggaggccaaggcggtggatcacttgagctcagaagttcaagaccagtgggcaacatggggaaaccccatctctactaaaaatacaagttagccaggcatggtggcgtacgcctatggtctcagctacttggggagctgaggcacgaggatcacttaaaccagggaggtcgaggctacagtgagccaagatggtgccactgcactccagcattggtgacaaagtgagaccctgtctcaaaaaaagagattaggctgggcacagtggctcctgcctgtaatcccagcactttgggaggccaatgcgggcagatcacctgaggtcaggagttcgagaccagcctggccaacatggtgaaaccccgtctctactaaaaatacaaaaattagctgggcgtggtggcgggcacctgtaatcccagctacccgggaggctgaggcaggagaatcgcttgaacccaggaggcagaggttgcagtgagccaagatcgtgccattgcgtgacgaagagcaagacttcgtctcaaaaaaaaagtaaaaatttaaacttaaaaaagaaattaaaattaaaagcaataaaggtctttaatggtaaaatttagtagggttttgaaaaaatattttcagctgggcacagtggctcacacctataatctgtgcacttcaggagaccaaggcaggaagatctctttagcctaggaattcgagatcagcctggccaacacagcgagaccccatcctaatttaataacgtgtgtgtgcatatatgcatattaaagtgtacatatatatatatatattttttttttttttttttttttttttcccccacggcaagcctaaaaaggttggcagatctggaagactactggacaaagggcattactttctaagacaacttgatgtttatgctgatgaaagccatcgtgaaggtgagttatcatgcctggccaacagcacaggcccctgctttagacaaggaggatgacatggcatgctctgcagcaaacaaagacctgctccaaccatccgcgggacgggaaggaaggcagacaggaacatgcgcataagtgtcctagcttctcctctcagcaaagactgatggtgcattctatagcttctttctctctcatttcctgcattaccatctcttgtatttagctcattttttttttccccgagatgaagtttcaatcttgtggcccaggctggagtacaatggcgcaatcttggctcactgcaacctctgcctcttgagttcaagtgattctcctgcctcagcctcctgagtagctggaatcacaggcgcccaccaccatacccagctaattttcttttttttgagacagtctttttccgttgcccagggtggagtgcagtggcgcaatctcggctcactgcaacctccactcactgcaacctccgcctcccaggttcaggcgattctcctgtctcagcctcctgagcagctgggattacaggcgtgcaccaccaagcccagctaatttttgtatttttagtagagacggggtttcaacatgttagtcaatctggtcttaaacgcctacctcaggtgatccacctgcctcagcctcctaaagtgctgggattataggcatgagccaccaaccctggcctagctgattttttatagtgaaacatttcaattcccttatttccttttttatttcttttttttttttcagctcttgttgcccaggctggagtgcaatggcgtgatctcggctcactgcaacctctgcctccccggttcaagtgattctcctgtctcagcctcctgagtatctgggattacaagtgcctgccaccacgcctggctaatttttagtatttttagtagagatgggatttcaccacgttggccaggctggtctcgaactcctgacctcaagttatccacccacctgggcctcccaaagtgctgggattacaggtgtgcaccaccacacccggcctcccttatttcctttttcataaattctataactattttctgtgaggttaccacgagtgttacattaaacatcctcttcaaccattatgcagatgaaaactgtcacaagccattgtctaaaaaagatttccactgatacaggacaaaacaccataaaggctcagtctactgggatttgtccgcttttagtaaagtaactaagcctaatctagattttcctaaaataggataaccctgtcctgcattttcccataactttcacttggcagaaaaggctccacccaatatgttctcaacttttaagtcaggagattgagaccatcctggctaacacggtgaaaccccatctctactaaaaatacaaaacattagccaggcgtggtggagggcgcctgtagtcccagctacttgggaggctgaggtaggagaatggcgtgaacccaggaggcagagcttgtggtgagcagatcgcgccactgcactccagcctgggtgacagagcaagactccgtctcaaaaaaaaaaaaaaaaagaaaagaaatacaattctttatacttctaacgtctagtatacttcattctagattcaataccccagaaaaacgttttcacaatatatagcattaggtaaatacttccacttatttgtttctaaaatctgtctgccaacacttagctatcttaaaaaggaaagctctgttctaatgaaggggaacatgtgaatgttccttcaaacgatgactctggaacaagagcatgttaccgccattctttacagagctaaatggttcaggctgcagaattctaaggtgaagaagtcatcctacttgatcctctaccacagaagatgggagtccaggtttccaaggccaactccagtatttaacaagagacaaacataatttgtacgatggaaagttctggcctagcctctgacacagactacaaaatgaaatacacaggaagagacagacctgacaacatgaacacacagcctcttggtaacttaagtttccctatttataagaaaataagactagaacgcttcttggggaagttgaagaactggtgagatacagttaaatccacagaaactcttttctccccccaagacagagtcttgctctgtcacccagagtgggagtgcgatggcgcgacctcggttcactgcaacctttgcctgccgagttcaagcaattctcttgcctcaagcctcccaagtagctgggattataggcgcccgccaccgcgcccagctaattttttttttttttttaagagtctcactctgtcacccaggctggagtgcagtggtgcgatctcggctcactgcaatctccgcctcccgggttctaacttttctgcctcagcctcctgagtggctgggactacaggtgcacgccaccacgcccggttaattttttgtattttttttttttagtagacgtggggtttcaccgtgttgcccaggctggtctcaaactcctgagctcaggcaatccacctgcctcggccttccaaagtgctaggattacaaacgtgagccaccacgccctaatttttgtatttttagtaaagacgtggtttcaccatgtcggccaggctggtctcaactcctgacctcattattcacctgcctcggcctctcaaagtgctgggattacaggtgtgagccaccatgcccagcccagaaacttttcaaaagatctctttcttaaattcaaaataactttttaaatcaatttcaaaagaagagtgttttaattcctcacaatctgagacattcaacgagatccaatgctgtcaatgagagcctagccttatacactagtgggaaaaaaaaaatggccttgtctgaaacacttttcacttgtcaatggttattttaactcagttaaaagtacaaaggtagtttgaaagaaggtttcagtgctaattcctaacctatttctaggcaaagtcaccaatgattaacacttttttttttttttttgagacagtcttgctctgtcgcccaggctggagtgcagtggcgcaatctgggctcactgcaacctccacctcccgggtttgagcgattcccctccctcaacctccagagtagctgggataacaggtgcatgccaccacacccggctaattttttatttttagtagagacagggtttcaccatgttggtcaggccagtcttgaactcctgacctcgtgatccgcccacctcggcctcccaaagtgctgggattacaggcgtgagccactgcatggccacattttatttttcaaaggagtcaaaggtttcttggccgggcatggtagctcaggactgtaatcctagcaattttgggaccccaaggtaggaggatccctcgagctcagagaccagcctgtacaacatagtagagacctcatctctataaaaaaatgtttttaattaaaaagatttaaaggccaggcgcggtggcttatgcctgtaatcccagcattttggtatgccaaggcgggcggatcacgaggtcagaagttcgagatcaacctggccaacacggtgaaaccccatcaccactaaaaataaaaaagacatcagccatgcgtgttggcgagcacctgcaaccccagctactcggctgaggcaggagaatttcttgaacccgagaggcggaggttgcagtaagcagagatcgcaccactgaactccagcctgggcgacagagtgagactccatctcaaaaaaataaaataaggttaaaaaaaaaaaaaaaaaaggagtcgacgtttcctaagtttctcctgggccatatattcattccactcatctccaggttgggaaacatggaggcaccaagagggcccctgactggagagatgatggaaccaccagagaacagccttgcaaataagtgctaggttctcctggagacccatttgtttgtgtgtgtgagacagtctcattctgtcgcccagggtggagtccagtgacgccacctaggctcactatgttgtccaggctggtcttgaactcctgacctcaggtgatccacccacctgggcttcccaaagtgctgggattacaggtgtgagtcaccgcgccgggcctggagacctattctagacaacacctggcaaaactgcagagactgtcacaatgctacagtatgaacattactcttcacccaatactgctaagcttcccccagaaatcccaaatcttccttaatattaaccaaaatgctcctgtccaatggtcagttagtttttttcccatcacatttacttttgggaagaaacttctcacaacttaacgagggactggttttctgatttgtcactgatattttttacgttaaggaggagtgtgtgacaattttttttttttttttgagacgcagtctcgctctatagcccaggctggagtgccatggagggatctcagctcactgtaacctccacctcccgcgttcaagcaattctcctgcctcagcctcccaagtatctgggattacagtgcgccatgacgcccggctaattttttgtatttttagtagagacaagattttgccatgttggccaggatggtctcgaactcctgaccccaggtgatccacccgcctcggcctcccaaagtgctgacatcacaggcgtgagccactgcgccgggccgacaatttcaatttcaggtaaaaagtgaaatcaacatcatttacaacattccttttaaagaggaattgtcaagttgtccttccaagtaaggagcaaagccggcaagttactgtgttttcattttcccaggtcttctggtggggagggagctctgtaacgtccccgtctgcagagctgctctccttagtgactcatgacaaggcacttgctgggaagcgggagagcaggaggagagaatcagagggagattaggataagaggtgtccctggctctgagaggggcaggactggctgggagtccctggaattagaccaggaagtctcctggagccgggaaacgggtggggaaggagggcggtttctcttcgccacagtccattctccctgcttagaaaggctcggcctttccctgcccagggcggggaaccggggtcgtaagtcccctggggagggacacggacgggaagcagccgaggggggtgaaagtccccgagaggggcccagccactacagagaaagccctggcgagagaagagaaaggggccgagtcgcggcgccggcaggcccgcctcccccacaggccgaggccggcaaatctgctgcctcatcccggcgtccccgctcccgcccggccgccgcactcacgatgctctcggccatggcggctgctcctgcctccgggctcgagccccgggccgccgccgcctgccgccccaagggcctcgcagacccggccgcggcctcagccccggccccggcctccctacgccgccgccaccgccgctccagcttcgcccgcccggctccgccagccgccgacgtcccggtgcctcgctcaatac

SEQ ID NO: 654 - DNA, 111345 bp, Homo sapiens
gccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggcctttgcctgggctgctgtcttcatccctggggtggcaatgcctgcctgcatcttgacgggcctcctgtcggctgctggaggagctgggagctctgtcaggtaaagaggaaaaaacagcatgcatcaggatggcagggggagcaggaggctgtgctcacaggcactgcacaggtgcagcacttccgtgttcccggccagcgggggccctgtgacccttggcctggctttcctccaggagtccgtgaaggccaaaggatcctggagtgaccagagagctgtggcctcgccttgctcagtgggtcctgcttggcagggactgggcctgcccctccactgggcacctggacatgtggctctgaaaatggtcctgttgtgaccatttcgtaatgggtcccaggagggggcaggggtgctgtgtggtaatgggtcccaggagggggcaggggtgctggggtaaatggttgactcaaagctcctccccccaggctgccccgggtgtccctaccatctgagacacattgcctgcccccgcctccccgatgggccagcagtgccaggcttttgaggccaaaggaaaggccgtgctggtgggcaccacgtggccaggcacaggccaagggcccaggagtgcgctacacacagaggctggggcctaaatgccagatagcccttcctaaacatcggctaaaaccatcttcgcagaggggtgttgtaggtgatcttctttatctggccagtttttctctatttttcattttttcaattaagaatgtgggggttttttttggtaaaacaacagcaaaatgttactaaaaatccatgcaagggctgggcttggtggctcacgtctgtaatcccagcactttgggaggccgaggtgggtggatcacctcatgtcaggagttcaagactagcctggccaacaatggtgaaacgccgtctctactaaaaatacaaaaaattagccgggcacggtggcgggcacctgtaatcccagctacttaggaggctgaggcagcggagtcgcttgaacccgggaggcagaggttgcagtgagccgagattgcgccactgcactccagcctgggcggacaagggcaaactctatctcaaaaaaaaaaaaaacaaaaaaaaccccacagtaagatgtgagctcagcgtccactgcgtggccacactgtggctggggtgaggtctagaggactccagcacgtggctgaatgtggcccagtgggcagtctggacaggctgacccaggcaggtcagcgggcggccaacgcctcctgctggagcccagcctgtgtggtctgcgtgcagcctgggtgactgggaagcgtctgtgctttggggacaccggcaatgacgcactctcagctgggctgcgcagtgcccatgggggcagccacacactcccagccctggccctgggcccctcttcccatctcagcttcttccactccgatccactcttggggtctcaagacacccggaaccagtcttccttttcctgcagccccgttggggtcacacagtccctggccccctgctggggtcctggggggccctggacgctgcctgctccctttgtttccaacccccagaggaattcctcctcttcacacaaaggctaccaccctttatctctcaacaataagcctgcctgacctcctggtcccggccaacgcccccatccccactccctccccccaccccccacactggctggcagagggtggggtatcccgtggaaagggcttcctgcggggaagctggtcctctgaccaggccctagtgctccactgtgaccctgaggcatctcctcaaacccagaggccttggttgtccctctgtaatgctcagggattctgggggctttgcccggcttgatcctcctcagacaaagcctgtggggattttcagaaaaagtgagctgagggaggggggtgaagggcctgcccctttgcctgggaggcctgagctggccctgctgggaggaccctggctgtatcccggggcgaagcagggaggtgtgagtgggtcacagtccccggggcagggaggggcagggaggggcagggagggtgagctggccccctccccagggcaggccggcccctagctcagaatatccactttacaggctctggtttcttcactggtccttttcctgcggagccctcctcagtgatggtggcagggaactggccatgagcccaggaccccagggcagcggacagccccagcccagccagtcctaggtcagaggcacggagctggatgtgtcaaggcggctgccccaggcgtgactccctgtgaccccggattcttctacctgatgctaatctgaggtcaacccagtaactggtgtgtaaaaacgctcttggcctccaccactctctgccccgccttctcgcctgacctgttttgccgagcctggccgggatttctctttctgcgttgggctgactgggccgcagggaaaccatgtggacacacagtttgccgggcacagcgtgaggaacgcgcctcttgggtcctgcacccctcccccacgggctgcttgtgctctggccccgaactgagcttctggaaagttcctgaaacatccaaggccttgcagtgattaaccaggggagggggactggggcctgcttgcccctcccaggcttaacccctcccaggtcctggtgtgtgctgaggcagggccacccaggctgggctccgtcccctcaggcggctgcaccatacttggagggttttttaaatttttatttttatttttgagacggagtctcactctgtcgcccaggctggagtgcagtggcgtgatctcagctcactgcaagctccgcctcccgggttcacgccattctcctgcctcagcctcccgagtagatgggactacaggcgcccgccaccacgccccgctaagttttttgtatttttaatagagacggggtttcaccatgttaaccaggatggtctcgatctcctgacctcgtgatccacccacctcggcctcccaaagtgctgggattacaggtgtgggccaccaagcccggcttggaggtttgaagctggtggaatctcagggaggacatagcctgtcctattgcagggaaggtgcggccctcactcccgtctcagcctgggggcatgagaactctgagcacaaagaggacggagctggtccccagctttctggccaccctgtgagtttcttctcctgcacctgagcctcagctcagctcttgaccaagttggcctctggtggctcattctccaggctgctccgggctctctgggtgcccctgggcacacctacgtggcttcctagggctttgggaagggccagacggtgagcccacgccttccctggttctccagagcctgccttggggctggggagggcctggccctgatggcagctcaggcctcaagtccattctgtggcacagaggcccttccgtctccctgtggcctccgctgctctgtgtggttcacccctgctgtgtcaagggcccttgttctgctgaaccccctctggctgccacaggggtcctcacgcacccaagatcaacccttctcaaatgcatctagttatttccaagtctcttgggaacaaggcttttcccaccactgtcagcacggcacccaggcctttagtgcagacggtgacagtgaatgtgacttgactccccccaccccgaatctccagaagctgcgtgcacctttccagggtccccacgcctgggaggctcacaggccacgcccacccgtgtctccccagcctgcgtcaaccctcacctgctaaagtctcctaatggacacccccacccctgagctcctggagctcagccctggggggtcaccgtggccccggggctgcctttgtgggactgagtgtgacaacaggagagcaatggggtacagggggagggaggcccacgtgatctggttcccacggtccctccacagggggacactccgggcctgctatgtccagctgccttccccacctcactggcacatggagcctggagcccccactgggcagatgcacaagaggggagggtactggacattgcatgctccagggctctgggcagtcctgccacccatcactcagcctggtgaggcagggccagcaggaaaccccagatccttcaggccccgcctgctggcctttggagcagaggagaggtgggccctcgggggcctgggcgccgaccacaggctgaccccttgtttcatgccagcacctcctctgggcgcctgtggctactcccccaacggcactggcaggtcccctgctgctgctgagcctgcccaggcctgtctgctacagcctgtcagtgttgcccaatgtgggccccatcccagcccttgagaggagtcacctagtagtggggtgcaagctggagccccaaggaagggaattcaagggaaacacatcgtgggcataaggctttgagagacgtgggtctgtccctaccggaggctgcatcacggaaggcgggcacacaggcctcacttgggcgagaagagacccagagacgcatggccttcctcctgggccggctcccgaccagagcccatctgagctcagcccacaggaaggggaggtgccaagaaccccaagcacaggtggctgcaggctggtgggtgccgaggaggccactaggaggctgagacggtgagagccagggccaggcagtggcctgagagctggacagcctctgggtatctccacaccccacccttctcctgcctttcagaagagtaaacgcaggagaacgccctgaggccccggaaggaaagtgacaggcagcggctgagctggggcgacaggaagtggcagctgtctccgctgtttcggaggcatgggaactgtttcctggtcctaaagtgaggaatgctggcctcatgccccttgggccaggactctgcactgagtgctgagtgcctgggctggtgtttagacgactcgtggtctctgttggcactgtctggggacagcaaaaagcagcaggggccagtgtgcaggggagattctgggtaaaattcatgaaaagggaactttcaaaaggggcccatggggccttcccaggtctgccaggccagcttacagctccaggtgggcaccctagcatctcagggccatagaccagcaggtcaccgccatgtccccggggaacagcactgcctgccactcactttgcctgagacccgtgtctcagggctgctccctgcatgtcttggcaggagggcggacagctgggaaggaggccacacgctcctccagggagcctggctctgcaggagctacgccagccacacacttatcagctgcccgacctgctcaggacactgagggccacatgcctggccaaaggcctctccccactccctcttctcccctggagaccaggcccctggagttgctctccagagatctgggcaatgaccctctggatcccagggtttttggttcccctgggaaaagaggcaaaggcccacacacctgcagcaggttgggggtggggggatgcatggcacagtggcttggcacccgggtggggcacagatgccgcgggagtggggagtggggagtggctgcctcgaaccctgctgtgtggcttgtcaccctccatggcgtctctgcgcctccgtttgactccagctgcacggcacacggggcgaggttagcatcaggggccaaagcggacccccgccagaaaggaggaagaggcccccaggtaggtgcgtgcttctggacctggcgctcggcacactgtgaggatgggcggatggagttggtctgcaggttccagaatgaatggggccctgttgtgacaggagaaggagggcagcctgggttgaagaaacaccccctgctgtccaacagctgcactgcccgctcccctggcaacacctgccacgtggactggagaagacacattagcccttgggctggaagtcgtggaccggcgtccacctgagatgggactctgggagggaacagccgccggccctcctgcctcagctgctctcagcatcctacagtgccatcgggtgctctcaggacagatgcctacagaacaggcttttctaaagaaagggggtgggctccagggcccagagtcacggcacggacgagggggctttggatcactctgcacacacctcaggatggaagtcctggtcagcaaatgcatgagcatttctggtggacccacctgctcctggggcaggctggtctctatccccattcccaatcccacgtgcctccttgcctctgtccacgtgatgttggagcagcaagccttctccaagctcagagtcagaggccacaggccactgtccccttggccaggccgcagtccttgactctggagcactcggagagcaagtggcagagacgagtgacctgcggccgctctggcgctctgcctcctagtgagatgagtgtcatggcttgcccgggtcctggagttgtgctgagagagcacctgacctgtgatcccacccctgaaaacgggctcctctgtggacagccgggctgttcttgctcctcgaaggagtcccccagcccctcaggaaagaggttcggccctggtcacagactgggcataaaatctgcatatttatagcagggtccgccgaaagcctaaaacaacagtgagtttcagggcaggatctctcttgcttgtgttgcattggtgtcatgttatcgctggctctgagttttaaagggaaatacacagggtagtgcatgtgacggtgtccaagacgcacagcagattttcattcacaaaaaaatctgaccacaagagctaaacggaaataccttccgctgtccttcccaagtcacagagcaaacacctcagttcccaggggtccgcatcagttctggtggaggcggtgactgtgagcgtgaccagctgggctaattcgtcctgacatttagttgggacagctatagtttcctacctctatgaccagagagtgaagcgtttcactgaagaactgtggccggcgtctccaggaaaggaaggagcctcgctttctccagggcaggggcagcgtggggcggggcaggccgggtgtgtctgtggggagtgggcgcgtgctcacactctttaagctgcgactgcttcctttaggacagaatgaagttcttcgaggaggccgatgaagacagaatatggataaggccaaacctacacaaaatccttctacatcttcatatcaaaacatgttaaacataaacctccaaatacctacagggatacaagcacagggcttcctaaacaggcgggatatgcagcctcgttctatcccaggcccacacagaaagtgttgggggagtcactgaaggaaggaggagaaagagctcagaagaagccataagagagcaagacatggacaggaaaccaagtggccccagcgccccgcaggagagctcagactccagggctggggtggcgcagagcggggcgtgtggagcgcatgcctgcgaggggcctacgaggcggctgcgaggcataaggttctgtgagcccggtgtgagctggcagatgttaccacaggacaaaattagaatgtgtaacttgtaaaacagcagagaaaaacttgatttctcccatgtaaaacaagaatgtaggaaaatgaaacaaatggaaaataaataatatggagattaagttccagtagacaatagttcaatggatatttatagatgagtaaactgactaatgaaaaagaattcttagattgaactttttaaaaataaagatccggccaggcgcggtggctcacacctgtgatcccagcactttgggaggctgaggcaggtggatcacgaggtcaggagatagagaccatcctggctaacaaggtgaaactccgtctctactaaaaatacaaaaaattagccgggcgtggtggcgggcacctgtagtcccacttactcgggaggctgaggcaggagaatggtgtgaacctgggaggcggagcttgcagtgagctgagatcgcgccaccgcactccagcctgggcgacagagtgagactctgtctcaaaaaaataaaaaatgaaaaaaacaaaagatccaacaataaaagatccagttaaaaagacagaaaaagtaaaaattaaaaaataaaatagaattaggcagaaaacgtcataagaggcaaagaagtctgttttttttttttttgagacagagtctcactctgtcacccaggctggagtgcaatggtgtgatctcagctcactgcaatgtccacctcccgggttcaagcaattctactgcctcagcctcccgagtagcagggattacaggtgcctgccaccacggccagataatttttgtattttttgtagagatgggatttcaccatgttggccaggctggtcttgaactcctgacctcaagtgatccaccctcctcggcctccaaaatgctgagattacaggcgtgagctgccatacctggccagaactctgtattttaaaaggtaagacttcagatgcagaaaaaagaaaaaaataaataaaaaggtacaacttcaaaacatgtcaagtactgacggacagagctgcaggaaagaggtaactgagagtagatgaagctgttaactcacccatgttcctcaaaaacaaacaaacccatgtcctcctggcaaaaactcattcatcaacggggactggttggcttgagtcatgaggcacaggaggtctaaccttacaggtagatgattcactttctctttcggcaaacagaccatgcctagaatctcatcataccaggccacagagcaagtctcaattcatttcaaatgtaacacaataaaatttgaaaccaacatcaaaacctctcatcctgcttctgcttcaaaattgtaaaacctactactgaataatttttggttatagagaaaatcataaaatgaattatttatgccgggcacggtggctcgcgcctgtaatcccagtactttgggaggccgaggcgggcggatcacctgaggtcaggagttggagaccagcctgaccaacatggagaaaccctgtttctattaataatacaaacattatctgggcatggtggcacatgcctgtaatcccagctactcgggaggctgaggcaggagaatcgcttgaaccctggaggtggaggttgcggtgagccaaagaaaaaaaaaaagaaaagaaaaaagagcatatgtgcaggagtagaaatagacagaagacagcctcatcatctcctcagcacaaaaacagaatcaaagacagactttgtttgtttgttttttgtttttgttttgttttgggacggagtcttgctctgttgcccaggctggagtgcagtggcgcgatctcggctcactgcaagctctgcctcctgggttcacgccattctcctgcctcagcctcccgagtagctgggactacaggtgcccgccaccatgcccaagctaattttttttgtattttttttagtagagacggggtttcactgtgttagccaggatggtctcgatctcctgaccctcgtgatccacccaccttggcctctcaaagtgcctagggccctttttttttttttttttttgagaggctgtcttgctctgtcgctcaggttggagcgcagtggcgtgatcgtggctcactgcagcttcaacctcccgggctcaaacgatactcctgccccagcctcccaagcagctgggaccacagacatgtgccaccacatccagtcttcttatcttttaaagcatgttgggccttgttttgaaataaagttaggttatatgttttcttgttttttgtttttgttttttgagacagagtctgctctttcacccaggctggagtgcagtggtgcgatctcggctcactgcaacctctagctccaaggttcaagtgattctcgtgcctcagcctcccaagtagttgaaattacaggcacctgccaccatgcccagctaatttttgtattttcagtagagacggggttttaccaagttggccaggctggttgtgaactcctgacctcaagtgatccatctaccttggcctgccaaagtgctgggattacaggcgtgagccatggtgctcgccttcttgtcttttaaagagtgttgggccttgttttgggtgaaagttgggttatgtggtgttttttcttttgttttgttttgttttttgagacaggagtctgctctgtcactcaggctagagtgcagtggcgcgatctcggctcactgcaacctctgcttcccaggttcaagtgattctcatgcctcagcctcctgagtagttgggattacaggcatgcaccaccacacctgactaatttttgtatttttagtagagacggggttttaccaagttgaccaggctggttgtgaactcctggcctcaggtgatctgcccacctcggcttcccaaagttctgggattacaggcgtgagccgccatgccaggccttggatttctgtagctgcagtttctcaggcaggttctagacgagccttcactgcagacagcatcagccctgttcccacggtgtggctcctcctgagtctccactgaatgtccacagtgatcactggggacccatccccctggctggagcttcagtatgtcatgaccgtgtgcgaggtctggaagttgttcaccttacatgctcctttctcctctttgcctggctttgtggagttttcttctatacatgtacaggctggtcctcagtacagactcaagagaaccctgtgcagatttctggagctcttttctgcagtttcctccttgcgggattctgccctgaaatgccggctccttctgtgtccccagaccctagtgcagtctcagctccgtaagggtgctcagctttgctcaggccctgcttccctccctgtgccggcagcccagaaacggccttcaggcagaaggccagggccccagggttcaccttgcctgtctcccttccaacaagggtggcggtcttgtccgggatctcggactcgtccagggtctcggtcttgttggggatctcggtcttgtttgaccagttgtccaatgtctgcaaacagttgtttcatatactttgtccagttttctagttgttcatggaggaacattaaagtctggtccttgtaactacggcctggccagaagcagaagtgagtgccagccgttgtgtgggcatagaataaatattatcagaaagtaagccgatttggttatttcttaatgtatttactttgttctaaaagttatttcaacacaagttactttcctaagtggcagtcatggtttcgtcactacaatttcaagaaaagagctaacagacatctacttgaccatctgtttctcagaaagttccaagactgccctgtcctttcagaagccacaggtcatgataatcagtgaaggcggggggctggggttgtccgtgccattcagggcaccccagtgctcccttcttggccagagcactggttcttggattcctgtagcttcagtgacaaggtgctgtggggctgtgcatccagcctcataaaatgtcaccagcgtgacctgctctctcagtcacagcttgtcctgagagcagcaatgggactagaacgacaggagcaggtagtgagaaacaagagagcagggtcctctccttcctggacagcaggactgtcctgatcccactgcaaggctgctgtgatggtgaccagtgaggcccgcgctgcatgtttttgcacactgaggagctgcctccattcattccccctcgcattcctggagcccacgtgctccttaccaagctcgcctcctggttcatgtttgggtgaagggctccactccacgccaggctgggcgtggggcccacacctgtcatctcagcactttgggaggccaaggcggcaggactgcttgagcccaggagttcgagaccagcctgggtgacatagtgagaccccatttctacaaaaaaataaaataacatgtaaaaagattagccagctatggtgatgtgcacctgtagtctcagctactcaggagacaaaggcaggaggatcacttgagcctggaaagttgaggccacagtgaaccaagattgtgccactgcactctggcctgggcaacagagcgagaataaagtaaataaataagagccccaaggcccccttgcctgccctgcagcttggtcttgcagctatgttgggctgtccatctcaccttggccatcaggagcctgacgtgcaccttctagtgcaggttacctgggccctgagggggttccctcgtcagtacacagagtgacgccacagatggaagagtggactgtaacgttccctgcgcgtttacagaggaggtacagactgttcttcactgtccccgtttcttaacatgtcacagccggctcctcacccatccatggcggggccatcccgacctgctctcctgaacgaaatgaacgaaagccctgggtgtcataagaagcacaaaagtgcctgcggaggtgggggccagaggcagcatggggacttctggctgggtgaggggggagggacgggggcgtgaggatgagctggtgctgaggccaaatgctcagggcatgtttttatgtcttgggagcccagctggtcctgcagaggccaatcacactgaaatgccactctggcgttctaccatcctttcaggaaaggcccagaacagtctcagctcaaaagcacaggaccccaggcaggggagggagggagtgtgtcctcggcgcccactggctcctgaatgcagaggctggcagcccctgcagggccacagtgactaggtggagggcggctggagctcggctgtcacgatcccgtgctctgtcttctcagtggcgaggtgtgggagtggagacacgctcacccacagccactccacccccaggcgtggtcccactggagcccaccaaacctctaaaattgtaaacatgactcttagctggagggccacctgtggggcaggagtgtgccatgatttggcccatactttgtttggatttacttagttgccaatattttgaaaaggaaacactttatatataaaaagaacaggatttccagcctctctcagaaaaatgggaagacaggcttgttggccccacactgccatggagggcggccctggggtggcactgacatggcctcagaagaccaagcccgcccgcagggacaccactgcccccactccacgaggctggcagtcaccctgtgcatgggcacctagtaccttctctgcagaggaggctctggcctggactggatccagggcttggattcagatcctgattccaccagctggggctgtgtgactttggacttggccttcatctgagcaaagagccccagcctgcggcaaccactggggccgagcagggcagtcactggagccctgtgtgatctccagcggaggctccaccagcattcgggctgtccgggaagagggggcaagagggggcaagagggggcaagagggggcaagagggggcggcttttgtccttctttccctttggatctttagatgagaaaagcctggctacaaggtgtcttcaacacacaaaactgcccagaaatgctctaattctacaaacagtttaaaaaaattaaccgagttagcagccagttaacagaattatgcgaccttaggatacattttatgggccaggcatggtggcttacgcctgtaatcccagcgcttagggaggctgacatgggagcattgcttgaacccaggagttcaagaccatattgggcaacatagtaagaccctgtctgtacaaaaaaagtttttaaaaattagctgggcatggtggcttacatctctggtcccagctactcaggaggatgaggcaggagaatcacttgaacctgggaggtggagtgagctgagatcgcaccactgcactccagccggggcgacagagggagactctgtctcaaaaatacaaaaaatttatgcaacctttttttttttttttttttttttgagatggagtctcactctgtcgcccaggctggagtgcagtggtaagatcttgactcactgtaacctccaccctccgagttcaagcgattctcctgcctcagcctctggagtagctgggtttacaggtgcctgcaaccgtgccaggctaatttttcttatttttagtagagatggggtttcaccatcttggccaggctggtcttgaactcctgacctcatgatccacccgcctcagcctcccaaagtgctgggattacaggcgtgagccaccgcgcccggccacaacctttttttttttttttttttaaagtaaacatctcaaaatctgtggagaaacaaatataaatttcaaaagaacaaattttttaaagaaaaaaaaagccagcattaacatgggacaccctttaaagttgtgaccatttttgctcctaaaccatcctctgcagctggagagtggggtggggagtgagggtgggaggcaggggggcctccacctagaagaaaacaaaatcactcacctccgacccacccacagggtgcatggcagggaccgcctccaaatcccacccccagggagcggcccaggggcggcccactgagccctggccccaatcttgatgaggctctacatggcggccctacccacttctcctatgcagtcttccccacccccacagcacagccgaattcctcagaagctctggccaagcatctcctctgaccccaggacatgcttggccctccccctgctctaatcagacaagtcccttccagaactccagggtgcagaacaagggctgggccttgggaccctcagctatgggatctgtggccatgtagcgttgggcctcatttctgcatttgacaatgggatggtagtagctgtacagccttagcctaaagacctgagcacaggtgagacaccaggtatggtgtctggcacttagtaggcactcaacaaatactcgaggaaaacacacagaaccattcccattatgtgtatctgtaaaccaggcttgcagccctccctctggtctccagtctaggtccccccacagcagggccctctccggaaagctcctgtctcccttcgagtccctgactttcagaagtcacaacaaacgcccatttttctgttgctagctttcctagtcccctttgaaaaggacaaaaatgtcgacaacacataaaccacatataagatggccaattgataggaaaaatgaccaacctcatcatttaaaaatggcgaattgggccaggtgcgatggctcacgcctgtaatcccaggactttgggaggccgaggtagatcacttgagcccaggagttcgagaccagcctgggctaacatggggaaaacccatctctacaaaaaaaataaaaaaattagcgaggcatggtggcgcacgccataaccccaactactccaggggctgaggtgggaggatcacttgagcccaggaggtggagtttgcagtgagctgagattgcaccactgtactgggcgacagagggagatcctgactcaaacaacaaccaggcaaattaggccaggtgctcatgcctgtaatccagcactttgggaggccaaggtgggaggactgtttgagcccaggagttcgagaccagcctgggcaacatggcaagatcctgtctacaaaatgtaaaaaattagccaggtgtggtggtacgtgcctgtggtcccagctacttggaatgctgaggaaggaggaatgcttgagcccgggaggttgagaagcctgggaggttgaggctttagtgagccatggctgcggcactacactccagcctgggcgacggagtgagactccatctcaaaatacatacataaaataaaatggactagaaaaaaaaggcaaattaaaaccaataatgaagtatcagttttgacttatcagattggccaacaaacaaacaaacaaacaaaccatttgctaaatccaccaatactgagtgaggaaaggtgcctcacgcctgcaaccaggagcagggggccaacgtcctgggggcaattgggtaacagcgctcagaactcaaactgaccctacctttgaccagctatttcccttctgatctaacagcagcctctgtgagcacgcagggcacacgcacaggaggttcactctcttaagagctaaaaacgacaggccgtccaagtgtccacaaacatcagacaccaaaacaaagggaggtgagccgatgcggcggctcacaaaactaccagaaagatctgtcggctctgtgtgtactgacataaaaaatactgcagacataaataaaaaagcaagctgcccccacgatatgcaattgacaagaaaagaggatatacacatatatttaaaaaaccacttctgttctgagggtggctggggagtctggaggggtgcagggggactgggcagttgtggcctggtgggtagggactgggagggagtaagagaagagggagaaggaacacagtccactgaaacccagtgtggtgttatccattagcgcaggactgaaacccgatgtgggtgttatccattagcgcaggactgaaacctgatgtgttattcattagcgcaggatgccccacgcatccggagatggggtttggaacatcctttgccccagcgaggtgcgaggtgctccggaacttgcggggcttagctgcccacacacgtgggacagactgttgggtggctggtccctgtaccggctcctgaaaggacatttgggcacttgatacacacccataaggtgcactctagggaggtggaggcaggcctgctgcagggggtcggcttcagaagcaggtatttctttggggtgaggtcagacatctgcctgggtgcttctctggaactgccttagggagagcttccgtccgcactgggtgccactcagtctgccgcgctttttatgtacgctgacttttgttgtgctgctgaagaatatctttccagtttgatgatttttcaggtaaaaacactaccttagaaatctgtgatttcttcacccgtatctaaggttaaccctcttccggccatttgtaaatactccattctacttctgcgtattttcgtggtttgccttggagtccctccctcgccctggaatgcctggtagtgtgtggtccccgtgagaggaagcggagatcagagtaagctgtgttcccaccctgccaattgctgaatggttctttctttccttggctcctggagaacaactacattcttatctaccaggctccactgagcgggcgggaggtgggggcgggggtgggggtgggagtgggggcaggggtgggggtgggggtggtgagaaattagtcgtattttgattagaatgacactacagattactttactttggagaaaactgctgcctttgtatatttaatgcttccatccaggaagtgtcatttttttaagcctcaaacatttttttggataatgcttggtagtttctctagcattatctgagactaacatcttctgagactcctgggttttgtagactcggggcctcccatgctcccatccctcacagttatctccctgtacgtggagcagacaggaatcaaggatcatgcccctgcacctgtgggtgcccccccacccctgtgcacctacgggtaccccacctgcagaccatgcccctgccctccgagacattctgaagcagaccgatagaatcaagtttaggaagaaaaatggcatggcctggggctggtgcaggaaggaaggaagctggatgggggacaggtctcttgggcagcctttggaggaggcaggtgctgggcaaacaaggagggtgcctgcaggtgctgcaaggtctgcaggtggggtacccacaggtgcacaggggttggggggcacccacaggtgcagacaggctggagctggagtgcaggtagctgggggaagaagggagggagatgaggctggacgtgctgggccccagcagtctgtgtgggagacctatctatctgaggctgtcataaaaacgcaggtgagagaggaggctaggcttggaggtgggtcctccaaagagccgcatccagggtgtatgggggagccccgactccagccagctgttccagcctcagaggttggccgtgccctgggacggggtgactgctgggtctggataggttggcaaagcagggctgaggacatgagcaggagggtggttcggggcctatcccaggtccaagaggagtatggctgttcaacacagctgtgtgacgtcgtgactaaacaccatatcctacaatagtcgttcatgtcattaatttagatgccactaaattgttaactatttcagtatcatttcattattattattattattttttttttgcagagatgttgcccaggctggtcttgaactcctgggctcaagtgatccgcccacctcagcctcccaaagtgctgggtttacaggctgagtcactgtgcctggcaacattattactttaaactccaatcatgactgtgtagtgtgcatactctgttacccacaatgcatggaacacgtttaaaaaagaggaggaaacttcctctccgtttctagaatggagctttcagactgcttgtctggcgagcgactgccgagctgcgctctgtcctagtgtcggtgcactggagggcgcagtgtcgcatcttaaccagaaacccggtgcccttaagtggcaccccttacttcaccaacgcagtttccaaggttttaaggaaagtattcttacatgaagtaaaaatatcacacagataattcagttaagcatgctcaaatattcaaaacacaaggaaagcatcaagatacttcgcagatcattaaacaactcaactgcatgaaccactttagtcttttcctaaatccttcacagggtgaatcaaaagccccatggacttatgctgaaacgtatctttcttgcttgcttttttttttgagatggagtctcactctgtcgcccaggctggagtgcagtggtgcaacctcggctcactgcaagctccgcctctcgggttcacagcactctcctgcctcagcctcccaagtagctaggactacaggcgtccgccaccacgcccggctaattttttgtatttttagtagagacagggtttcaccgtgttagccaggatggtctcgatctcctgacctagtgatccacccacctcggcctcccaaagtgctgggattacaggggtgagctaccgcgcccggcctcttgcttgctttttaattgcaacaccgatgctaagaaataccagccgttgccaggcatggtggctcccgcctgtaatcccagctactcaggaggctgggacaggaggattgcttgaggccaggagttctagcccagtctgtgcaacacagtgagaccgtgtttctaaaataaataataaagaaaaaataaataccagccaccctgtctcagcctagggaggcagggacatggcagggcctgcatctggccacctcctccacctgctgaggcccccagtgcttccccagctttcctgccaagaggccccagtgctactgagctgcaggcagcaggctctcgaggacatgacctcactcacagggctcagggtctaagactctgttaagacaggcgcctggagccgggtcatagggaggcaacatgacccccacagccaggagatggacagcaggtctgctgagggctctgggcagcttctccctccctgattaaaagaaaaagattcaggagagagaggcccttcaccttttggccttctcaggggatggtgggagtgtctgcagccattgcggagccattaggagaaaagagaatcccagaggggccacctgaggcccgttgacctgggactgagggctccgatgagctcctgggcctcagtcagcgcgtcctgccatggggccgtgcatgccgcctgctgagaccattttgggcactcaggatatggacccctcagttctctccttattttagtgaggcgtgtcattttccacagttaccacgaggagataaaggccgggaagctctggttcacgtcactttcatatcctgtcctgtgacttgtagctaaaagcatcttaactgatccacaccagcccgccttccctcccaggccacccacactctcagcctcggtggacgtgtgctgctgtgtcaggaacgctccttcctgcagcacggcctcggccccaggtgactcctgtggtcaccagctccctggtctcacagagagcttggtggccctcttcactctctcccggatctgcttcctgaggcgccaacccaccattttacaacccactttctcaagcctcctacaccgctccttcctccttcagagcctgtggccggcctcgggctctcagcctggatgctgagcatgtaagaggaaatgaaaggaatctgccagaaccgtttcccaccaccaggccagctgctgggaccagggacagcctccctggggcctgtgcactcccgcacggtggaggctgccctggccactgctgcagaccctttgcaagggcgtctgtccagcaagcagctcagaagtcggagcaagcatctccctcaggcccagggcaggtgcttgtggcgctctaggactcggagggcaggtgctcgtggttgctctaggactcggagggcaggtgcttgtggtcgctctaggactcggtccccaggcctgggttcctcagctgagatgcatacccactgcacctgcagccactgcctgcccagctgcctgctatgtggacagagcccttggtctctgacccaggagcctcctgtctcccgccaggcttgcttgtcagcttgcaggctgggcaagtgcacagcactggctgcaatcaaccttctggcttcggtgcccacctctgcctctgtcctattaaaggccagccctgcacacgggcaccgagccccttcccctgcctcctccaggacttctctcctgagtcatcccatttcccactgcctaccggcaggctttacatgacagcttgtgagcctcccctcttgactccacatcttcataaatacggcctcttttcactgctgattttcagagcaaagtttcttggatatgttgtccatcccatctcccatcctctccccaagccgggaaggattgaatgaaaattctactacccccctgagaccacacttaagaccaccagtgaccttcaccttgcaaaaaagcaggggctgcttctctgtcctgacctaactggacctacctgtagcgttccactgcacagtttaaccactccttccctcctaataactttttttttttttttttttttgtagagacagggtcttgctctctcacccaggctggagtgcagtgtgtaatcacagctcactgcggcctagaactcctgggctcaagtgatcctcctgcctctgtctcccaaagtgctgggattacaggcatgaaccagtgtgcccggccctttttttttttttttttttgagatgatgtctcactacattgtccaggctggtgtggaacctctgagttcaagcgatcctcccactttagcctccccaaatgctgcaattacaggagtgagccaccgcccggcctatagcaattttcatgtcagacaaaataggttttttggtgaaatacaacatgaggggttatgagggatgttacatactggtaaagggaggaaaagatcaagaaggcaaaaaacctaaacatgtatgcacctaacagcgaacctcaaaacacataaagcaacaattgacaaaaacagatagattgataattgtagtttaagaactaatatttccctctcagaagagttaacatcatagtaatttaattctctgaccagaatgtaaaaatattagaaatcagtaacagacaaaaaaataaaattccacaaatctagaaacttaaggaaaaattccatttaagttaaagcaaaatgagttgagttataagtcctacaagggaaagacaagggaaacatgaggatgttgagatttatgagacatggttaaagcaaagcaacgcttggaggaatatgcatttctttggctgcattggtcagaaaacaagacagatttcagacttgaagaaggcatcatgaagctagcactcctccactatccttgtaaatcatccaaaagcaaaaaaaaaaaaaaaaaaaaaaagataatgaaaagcaaaaatgcaaacttcattttcattaaaactaagagctagaattggtggtggtggcgggggctaccaaaggctgcaggaactcggcaagggctgtgtcaaagacatacagatgcctcgttacagaccccagaaagagcagagggcatttctctaaggcaagggtacaccctgagggtaggacctaattccttgtttcaggagtaggaacatgggctggcagcaagtgcttccctgaccttgttccgttcctggaagagaggagggagagtgaaccaggaacagaacaggccctatctgcaaagtgcagtatctgtggggaaagggaagagagaagctgtatcagctgttaaaagcctgataggtggagacttgtatttaaagctaaaatcaacgacacgactctgctgggctggaagatggttctggcttcattttccatacaaactttttcaaatagctagtcaagtaaaaatttacctgttctaaagatgaggccaggcacggtggctcatgcccgtaatcccagcactttgagagcgtaaggtgggaggatcacttgagcccaggagttcgagaccagcctgggcaacagagcgacaccttgtacctacaaaaaactaaaacaatcttagctgagcgtggtggcgtgtccctgtggtcccagctacttgggaggctgaggtgggagaatcacttgagcccaagaggtcaaggctgcagtgagctgagattgccgcactgcactccagcctcggtgacagaatgggacactgtctctaaaaagagaaaaagaaaaaaaaaatgaggggggagccaagaaacgaaagtgctccaagagaaaaggagaaaggaaacaagcaaacgaatgaacacgaacgtctccagaagaactttccattgagttgatgaaaatttggacaaaatgttttgtggtgaattaaaaatgcaaggaggcggtgcccctaagaatcctgagcacagaggagagccatggagtgcaggtgggagggtcaggaagacggagtgggacgcggctgcgtggaagacagagagaaacgcgccacattcgtgatgccagcactggagcacacggggaacggaagccacacaaccccattccttcctaaggcagaagggaagctgcgtcaatcctaagaacacttacaatagtgtttgtggggaggggctgggggaaccagactcagacaagccaagtctaaaaattatatacaaaaaaggccgggcatggtgactcacgcctgcagtctcagcactttgggaggctgaagcgggaggatcgcttgagcccaggaatttgagatcagcctgggcaacatagggagacaccatctctactaaatttttttttttttttgaggcagagtctcattccgtcacccagactggagtgcagtggtacaatctcagctccctacaacctccacctcccaggttcaagtgattctcatgcctcagcctcccaagtagctgggattacaggcatgcgccaccaggcccagtgaatttttgtatttttagtagagacggggtttcaccatgttggccaggctggtcttgaactcctgacctcaactgatccacctgccttagcctcccaaagtgctgagattataggcacgagccactgcctccagtcctctctctactaaatttaaaaagaaagaaaaaagaaaaaacaaatacatgcaaataaccaagaaaaccctgagagagaaggataaagaggagatcctacatcagccagacatgtaaaaggaccaggaagtgacactgattctgacccaatggaactgcctgtgaacagactgagagtggccgaacgaaccgtccggatatagctccaaaagcacatggaacatttagcaccatgacaaaggtgggagtccgaatatgcgggaagtgtgagcgatggaaaactgggagccgttgccactttgggggttaataagaagtggttctggccaggcacggtggctcacccctgtaatcccagcactctgggaggccgaggtgggcggatcaactgaggtcaggagttcgagacgagccagcccagcattgtgaaaccccgtctctactaaaaatacaaaattagcctggagtggtggcgggtgcctgtagctccagctactggggaggctgaggcaggagaatcatttgaacccgggaggaggagcttgcagtgagctgagattgcgccattgcactccagcccgagcaacaagagcaaaactccatctcaaaggaaaaaaaaaaaaaacagacaagataaaaaacaaggacattaaattacataaaaataaaaaatatgaacataaaaaaacaccataataaacatttaaaaacatgaagaactgggagaaaacatttaaattgttgtcaccgaaaaggcctaatttctatcacatataatgagctgctacaaatcaataagaaagaccacaatctaatacacaaatgggcaggtaactgaagaacagggaaaggaagtggctcctaaacacacacgaagatgcacgacctcccagcagaggcgctgatgccaatcctgctgccaccggcaaaagttccgtgtggctacaggactctcagacactgctgctgggagcagcctctgggtgggtggcggaggctgaggcgatgctgtccaccacacgtggcacgcgggcagccttgactacgcaagcccctggggcacgtacacgtgtgttttcacacacactgcagcctgtaaggttactattctaacagtatctgtgacggtaaaggactggaaatagcctaaaatgcgcatgaaggagagaatgattaaatgaatgaggcacaccctcatgacggaagacagaagctgtaaggtaagaaggggacgccctccatgcaggcacacaggaaggacgcacgctcccgccccaaccacatcacacgtcccgcaactccagctgcctcgaagcagcatctgtttccctccccccttctcgctacatcacagacccatgcagtcctcacaaggtgcacccttcaaacagacttttctgaaaacttcctgagaccagtagcaggagctggcactgtgacctgctgagtttaccaggcctatgacttaggtgcagagaagagtctcagggcggcaacgtccgcgcagcaaagcaggacgaggatgaggatgcggctgacacttgtctggcccgtgaggctgagcatcactggggtcggcctggctcttccccgggagcatcgctggggtcgacctggctcttccccaggagcagggccgtctaaagtgcaccaatgcccacgcgtctcacctgggctccattctaagtcagcctgcgcccgggtgtacagtgctccattctaagtcagcctgcgcccgggtgtacggtgctgcattctaagtcagtgtgcgcccgggtgtacggtgctgcactaggaaatggcatggtttctgcccttcagggctttgcaccataacccgggaaacactcaggtgccaaatgagaggtaaagagactccatgcattactcaaccaaagtgcagggatttcagggtgcaggaggcacgcagggtgctgactctccacatgcccctcggagagggtggccctcgccagctgccagctgtgggcagctcctggggagggcagtctcctacctggagttgagtcaccctgggaggtgacaccagaagggctggatcccaggtctagcaacctccacatgtcctggagggtgccactggcaaaggaggaggagctgtgggattggcgaccatgctcctcagggtgctggggagcctggggtggctttggggacctgtcttctttctgccgaggtgatttacaggtcaccgtgtggatgctgtgttgtgtctagaaaagacatcatcgtcttgaaagccaccctctccaacccagaggaagccacaggactccccccaaccactcccctcggagcagtaaggcgacagtgggcctggcttaaaggcccaggcagatgctcccaggatcacccaggagaggcagctgcagacagggatgcatccggggagcgagtctcagcgctgggaacgctgagtgtgggcagggcctgaatctcagtgctcgtctcaacacttaaatgacaaaacatgtctagggcagaggctgtttcgtttcgatggggaatgagctgaaatgcagggcagataccctgaggggcacagaaaggaaaggccagcgtgggccccatgtgctttaggggtcccggggccctcctaacactcttaccacccttgtgggaccacccggcaaacgctctgcagctcaccctgccattgtgagcagtccctgatgacggcacaaaggcaggcatgcagagcgaaggcccctccgagaggcccagagcacccaggccccggcttccctgctggccacaccccacacagctgcacttgctcgggcgccgccactctcaccttcgggccttgcagggcgtcaagtctgctgcccacctgtgctgagcggggctggtgctttcccaagtgtctggaaggagcctcatcctcggcactcttggcgtcctgccgtggggatttaaatgagaggactctggtattcacatgtactgatggtgcatgtcagtgagttttcccacaagattgggaagaaatgccttcccacatttctggtattaaagactcacaccatttggtgacagcccggactgaagggacctgtttcccagacaggaggaatggagcaggcttccccagtcattcattcccaggagccttctctgcaaggccagggcagcctatgcatggcctgcctggggtgagagccccccggcccaagatggacacgagtggcccccagtgacaccacctggccgatcctgcttttttgttttttttttttttgagacggagtcttgctctgtctcccaggctggagtacagtggcgtgatctcggctcactgcaacctccgcctcctgggttcaagtgattctcctgtctcagcctcccaagtagctgggatgacaggcacccaccaccatgcccggctagtttttatatttttagtagagacagggtttcaccatattagccaggctggtcttgaacacctgacctcaggtgatccgcctgccttggcctcccaaagtgctgggatcacaggtgtgagccaccacgcctgacctgatcctgcttcttgaacccatcactggtgcctctgcccgccccatgcctgatgtctccccccttctggagggaagactgtggaaaggaagccaaaagggggcactagggagcaaaccctaagaacatggaaaggaaacatggaggaaaacagaaagggaaattcaaagcagtgggacctgtacagagccatggacaatagatggcctgcaaggaggctgtggaacgagcccagccctgccccttcccaggcacaccatgagtgtgcccacaacagtggatgcagagtgtacttggcccatgtttaccaacgtttgcctgttcacccgaggaatgcacatgcatgaggtctgatgtaaggtccctgatgccagtgatcacgggcacagcctgatgctcactgccccccgggcttcgtccccagtaccttctgatcagaccctttgcctgtttgtcacagggtgatttgtctttttcttattgatctgtaggagttcttttctgtatttgtatcttatttcttctcatatggcaccatttactattaaaaatacagaggaaccccttgggaggctgaggcaggaggatcactggagcccagagttctaggttccagtgagcctggatcacaccactgtactccagcctgggcaacagagcgaaactctgtctcaaaaaataaataaataaaaaattaggctgggcgcggtagctcacacctgtaaccctagcactttgggaggccgaggtggaagaatcccttgactccaggagtttaagatcagcctgggtaacatattgagaccccctatctgtacaaaaaaaaattaaaaattagacaggtgtgatggcacacacctgtggtctcagctactacggaggctgaggtgggaagataatgtgagcctgggaggaccaggctgcagtgagctgtgatgtcatcatggcactccagcctggggagcagagaccctgtctcaaaacatttttttttgagacacagtcttgctctgttgcccaggctggagtgcagtggcgtgatctcagctcactgcaacctccgcctcctgggttcaagtgattctcctgcctcagccttccgagtagctgggattacagatgcccacccccatgcccgactaagttttgtatttttcagtagagatggagttttgccaaattggccaggctggtctcgaactcctgacctcaagtaatctgctcgccttggccccaaaaagtgctgggattacaggcgtgagccaccacacccagacaaaactttttttttttttttttttttgagatggagtcttgctttatcacctaggctggagtgcagtggtacaatcttggctcactgcaacctccacctcctgggttcaagcgattctcctgcctcagcctcccgagtagctgggattataggtgcctgccaccacaactggctaatttttgtatttttagtagagatggggtttcatcatgttggccaggctggtctcgaactcctgacctcagatgatctgcccgcctcagcctcccaaagtggctgggatcactggtgtgagccaccacgcccagctccttttttttgggggggtgggggtgggggacggagtctcactctgtcacccaggctggagcacaatggcactatctcagctcactgcaacctctgcctcctaggttcaagtgattctcctggctcagcctcccgagtagctgggattacaggtgcctgccaccatgcctggctaattttttatatttttggtagagacgaggttttgccatgttgcccaggctggtcttgaactcctgacctcaggtgatccacccgtctcggcctcccaaagtgctgggattacaggcatgagccactgggcccaaatactggccacattttttttaaaagaaaaataaatgtaggccaggtgtgttagctcacacctgtaatcccagcactttgggaggctgagacaggtggattacttgaggtcaggagttcgagaccagcctgggcaacatggcaaaacctcgtctctatcaaaaatacaaaaattaactgtgtctggtggtgtgtgcctgtaatcccagctgctcagaaggctgaggcaggagaatcgcttgaacctgggaggcagaggttgcagtgagtcaagaccacaccactgcagtctagcctgggcgacaaagtgagactccatctcataatgaataaataaataaaataaatacatgccgggcctggtggctcacgcctgtaatcccagcatttgggaggcagaggtgggcaaattgcttcagtccaggagtttgagaccagcctgagtgacacggtgaaaccctgtctctattaaaaaacaaacaaacaaacaaaaattagccaggcgtggtggtgcatgcctgtagtcccagctacttgggaggctgaggtggaaagatcacttgagcctgggagacagacgttgcaataagccgagactgtgccactgcactccagcctgggcgacagagcaagaccctgtctcaaatataaataaatacattttaaaaagaaataaaaaaggaaacacaaagcagtcttggctccatagagttttcttttctcagttttaagagttatttcttatgcctgtaatcccagcactttgggaggctgaggcaggaggatcacttgagttcaggaatccaaggccagcctgggcaacatggcgaaaccctatctctacaaaaaatacaaaaaataaggccaggcatgctggcgggcgcctgtaatcctagctacttgggaggctgaggcaggagaatggcgtgaactcgggaggcggaggttgcagtgagcccaaattacgccactgcactccagccttgggtgacagagcgagactctgtctcaaaaaaaaaaaaaaaaaaaagaataaataagaaaggatagccaagaaaattttgtaaaggaacagaaataaggtcaagcttgctctaacagatattaaaataggtcacaaagccacagtatttaaagcggtatagtaccatttcaggaacagacaactcattggaactgtgtagaaaaccccaaaatcaatgcagaagctgaacttctcaaggctgcaacatgagacagatccacagtctacaaaacactgcctgacttttcaaaaagacacggaaaggcggagggagtgttctgggttaaaggatgaaaacacaagagccagatgcagtgggaattcgggactggctctgaggttacggaaaattagcaaggaacacacataaatcacccacagaagaagaactataaatggccaataaatagattaaagcatttaatgccactaaggatataagaaatttccttccttctttgttttttggtagagacggggtctcgctgtgttgctctggcgggtcttgaactcctgggctcaagcagtcctctcacctcaacctcctgagtctgggattacaaggtgtggactaccacaaatgggtaatttatttttatttttatctttctgtagagacaaccttgcttttttttttttttttttgagacggagtcttgctctgtcgcccaggctggagtgtagtggtgccatctcggctcactgcagcctctgcctcctgggttcaagcaattctcctgcctcagcctccccagcagctgggattacaggcgagtgccaccatgcccggctaatttttgtatttttagtagagacggggtttcaccatgttggtcaggctggtctcaaacttttgacctcatgatccacccgcctcggcctcccaaagtgctgggattataggcgtgagccaccgcacctggccatcttgctatctttttaaagatacaagttgtggctgggtgcactgactcatgcccataatcccagtactttgagaggccatggtgggcagatcgcttgagcccaggagttcaagaccagcctgggcaacatggcaaaactccatttaaacaaaaaatataaaaattagccattaggcatggtggtacacacctgtggtcccagctacttggaaggctgaggtgggaggatcacttgagcctaggaagccgaggctgcagtgagctgtgattgcaccactgcactccagcctgggtgacagagccaggccctgtctcaaaggacaaaaaaaaaagaagtttttgggttctgggtgacagagccaggccctgtctcaaaaaaaaaaaaaaaaaaaaaaaatagaagtttttggtttttttttcacttatcataccagattaaaaaaatagtacccagatatgtaaagctatagtaaaacatatacatgatacaatttgtaatgaaaaaataaaaaaaaatgggggctgggcgcggtggttcatgcctgtaatcccagcactttgggaggcagaggcgggtggatcacctgaggtcaggagtttgaaaccagcctggccaatatggtaaaaccccatctctactaaaaatacaaaaattagtcaggcgtgttggtgcatgcctgtaatcccagcaactcggaaggctgactcaggagaattgcttgaaccgggagggggaggttgtagtgagccgagattgcaccactgcactcaagcctgggcaacagagcaagactgtctcaaaaaacaaacaaacaaatgagaaccaaaaccaaaccaaaacaaaacaaaaacccagcagaaaacacattgaaatgttactaataactatatctggatcctgaaaattggaggctttttatattgtgtttattgtaatctgaagtttctgtaatgaaaacgacacaattagggaaatatttttaaaaatgcatgtcttagatgaaggggtgttacctgagatgtaaaatggggctgcacctgtcccaaaggtgggctgcgatccaaaggcctcctgggctcctcgcctggcttccgggcctcaggggcaggagggagggcgtggtgcaacagccaccctgggaatgggatggggacagagtttgttctctgtgcatcacttctggattcctcttgtgttgaatgcaaacactcagaaagaacagcatgttccttttcaaaaccaaagtaacttccattacatcgagaacttggggagggccggacaacagtgaactgtgacacacagcatttcggtagagctcttgcacacacaatgccacgcccctgccacacacagcccttgctgtcctcacagcgggggcagcaagcacattcgctaacagaagcacccagacgccctttctgtggcaggcacaaagaagaagcaaaaacttgccaggtgcggaggctcacgtctgtaatcccagcactttgggaggctgaggcaggttgctcacttgaggccaggagttcgagatcagcctggccaacatggtgaaactccgtctctactaaaaatacaaaaattagctgggcgtggtggtgggcacctgtaatcccagctactcgggaggctgaggcagaagaattgcttgaacccgggaggcagaggttgcagcgagccgagatcatgccactgcactccatcctgggtaactccatctcaaaaagcaagcaaacaaacaaacaaaagaagcaaaagcttaagtataacaacttaaaaatgatggttctactcaaagcttcggcatgctagcttacttagaaatgaccccacatcaaacgagatcctttcatcaattccattcatgttatgttatgtaaagatctgctccttctctaagcagacacatcagaagacataattactgaaataacatttcccaggattacaaatcagtttcgttaaactcactgaggattccaacaaggtttttggagggtgtttataactgttgacatttcacatattggaaattgaaacagacatttttttttttgagatggagtttcgctcttgtcccccaggctggagtgcagtggcgcgatctcgacacccccagaacatccacctcctgggttcaagcaattctcctgcctcagcctcccaagtagctgggattacaggcatgcgccaccacgcccggctaattttgtatttttagtagagacggggtttctccatgttggtcaggctggtctcgaattcccgacctcaggtgatctgcccgccttggcctcccaaagtgctgggaatacaggtgtgagccatgtgcctggtcaaaacagaaaaattttaaagcttttttatcaattaacttgaagttagccatgatgaacatattgcttatgatcaacatctgaggagcatcgcaggattagctctgccctgtggacatcccgagatgggccctcaagtaaagcatcagtttcttctacgcaataaaagaacccaaagatgacacttggaaatgaacgtgtttcccttggtttataaacacctgaatttaaaagccatgaagtcagaagatgcacgtgtgggcaaaaacctcctgaagacactcaacaccattggtcaccaggagaatgtaaaatcaagcccactatgggatcccgcctcacacccactaggttggctgggatcaacaggatagaaaacagctgggtgcggtggctcacacctgtaaccccagcacactgggaggccgggtgggggggatccttgatgtcaggtgttggatactggcgtgggcaacacagtgagatcccacctctatttttaaaagaaatttttttaaatataaaaaaaataaagtttttaaagatatgcaataaaagtattcttaattaaaaaaaaccccgacagaaaatagcaagtgctggtgcagatgtggagaaatcagaaccttcgtgcgcagctggtgggcatgggaggcggtttggtggctccttaccaggttagacacagaattcccacatgacccagcaaggccacttctagggaggcatccaagagaactgaatgttcacagcaatattattcacaatagcccaaaggcggaaaccatccaaatgtccatcaaactgatggacaaatgcctacagtggcctgtcccccagcaaagagctcttcccatggaaaggaattaagtgcagacgccccagcacgagggaccctcaaacaggacacagagggaaagaagccaggcacaaagggacacatcctgtgggatcctgctgaagtgaaacgtccagaacaggcaaaggcatggaggcagaatgtgggtgctgggcgggggacaggaagcaactgcgaatgagtgtggggtttcctctgaagtgaaaggaattctggaacaaatgatgatgctcgcacaacattcttgacgtgcttaatgcactgaactgtatactttgtatacttcatgagctttcaacagtacattttatatgtatagtaccaaaaaaaaaaaaaaaaaaagaaaactagtttttttgagacagagtcttgctctgtcacccaggctggagtgcagtggtgcaatcgcggctcactgcagcctccacctcctgggctcaagcgatcctcccacctcagcctcccaagtagctgggaccacacccagccaagttttttgttttttagtagagacagggtgtcactattctgcccaggttagtctcaaactcctagcctcaagtgatcctcctcccttggcctcccaaagggctgggattagaggcatgagccactgcacccagctgaaagctaggtcttgttttctcaatccttacttggttgaaagaaagctagttttttaaaaagccatgaaatgtgttaaaatcttagcaaagttagcccaattttgatgggtttgtttccttggtgtactacttttttttttttttttttgagacagagtcttgctctgtcatccaggctggatggagtgcagtggtgtgatgttggctcactgcaacctccacttcccaggttcaagcaattctcccgcctcagcctcttcagtagcttggattacaggcacctgccaccatgcccggctaatttttgtatttttagtagacaaggggtttcaccgtgttggccaggctggtcttgaactcctgcaagcatcctatgatccgcccacctcggcctcccgaagtgctgggattaccggcgtgagccactgcacccagccttccttcgtttactatttattgacttcccctaaactatgaagggttattctttactttctatgtaatctgttcagacagcaaaggtgctgtcttaccagggtaattttccgtgcttttgttgacttattatgtcttgatggtttcagaaaacaaagcttcccatgcttatgaaagagctaagtttctctataactgttctctcctatgtttaagctttttgtcactttcacgtgggtagctaaatattatttctcaggtacccatgagtcttaatgttcaaatctcctgacatttttttttccttctcaaaattgaattctaaatgtcaaataaaataaagctttcaggagacttttcttttttttttttttgagatggagtctcgctgtgtcgccaggctggagtgcagtggcgcaatctcggctcactgcaacctctgacttcttggttcaagcggttctccttcctcagcctcccgggtagctgggattacaggcacccgccaccatgcctggctaatttttgtatttttagtagacgcggggtttcaccttgttggccaggatggtcttgatctcttgacctcgtgatccacctgcctcggcctcccaaagtgctgggattacaggtgtgagccactgtgcccagccccaggagaccttttatatttaaaatgatctatgagatgtcctagaagttccctggaaaatcacaaaatttttttcttataaaaagagaggtatttgaaataattaggtacaaggtggggtgtggtggcatgcgcttgtggtcccagctacttgggaggctgaggcaggaggatctctttttttttttttttttttgagacggagtctcgctctgttgcccaggctagagtgcagtggtacaatctcggctcactgcaagctccgcctcccgggttcacgccactctcctgcctcagcctcccgagtagctgggactacaggtgcccaccaccacgcctggctaattttttgtatttttagtagagacagggtttcaccctgttagccaggatggtctcgatctcctgacctcgtgatctacctgcctcagcctcccaaagtgctgggattacaggcatgagccaccgcacctggctgagacgggaggatctcttgagccaaggaggtcaaggctgcagtgagctgtgatcacaccactgccctccagcctgcatgacagaggtctctatcgaaaaaaaaaagtaaaaagaaaaaagatgttaaggaaatgattaggtttctttgatgtgttaggattgatgagtgccacgggaagactgccgagtcggaagagacgcatggcctgccccgggtcggaagagacgcgtggcctgccccgggtcggaagagacgcgtggcctgccccgggctgtgtgtgtcaggtaacttgttcgtctgaggcactgaggaactgtgtgctgtgctgcacggagacgtcccgggtgcccacggcgcttctcttcattagagtcccgaagccatttgccagatgctgtcagccggcagcagtccagagctagcaggcataaaccccgtcactgccgttacgttaacttaggtgtcaccttactttaacgtgagctgtgcatctctgatgcccagagtttgtagcagggcgaccgtcactcactctggggctgtgttactaggcagacggccaccgcctgccccacactttttgcctctccactggatattcttggtatagtcatggaatagtcagcttcacacttatctgtaaataatttcctctgtaaaaatcatgctcatccagttttagaaatcagatattctgtttctggcatctttgaaaacagcgtcaacgtcttggattaactttgtctagaactcttttttggactctgtttccagatgtctacaggacaagcaaatgttccttctcagttgcattattcttgctatgaacagacctttcactttgaaaagtggcagtggtaaattcaccatggccatgtgcagtcttttgtcatccacagtttttttatttttattttttgagacgaagtctcaaagaagactcctgacccaggctggagtgcagtggtgggatctcggctcactgcaacctccgcctcctgggttcaagcaattctcgtgcctcagcctttcgagtagctgggattacaggtgcccaccaccacacccagctaatttttgtgtttttagtagagatggtgctttgccatgttgaccaggctgatctggaattcctgacctcaggtgatccacctccctcattctcccaaagtgctgggattacaggcgtaagccaccacgcccagccccatccacgatttttgtgttactctgatgctccccagaaagctcagagtgcttcttcatcttgaacagggactgtctcagagcctgggaaaaggactgggcaggcaccatgggcacaggcttctgatggcggcatttagatgacactgagcccatcccaggactcagtctctagtcgagaagcagatggattgttgagaccaagaaccaagatggagtggaacaagaacggacctcacaggaggggatgaaccgatggtggaggatgacagcttttgttaagaatacggctgatgtttttttaatgttctactttctggatatatagagaactcttcctctttcctctgaagctatgtacagtccacacaaattttgtagtctctgcttttgtgaatcaaaacagaacatttgtaagtgataccttgttttttttgtttgttttttttgagacagagtcacgctctgttgtccaggctggagtgcagcagcgcaatctcggctcactgcaagctccgcctccccagttcacgccattctcctccatcagcctcccgagtagctgggactacagatgcccgccaccacgcccagctaatttttttgtattcttagtagagacggggtttcaccatgttagccatggtggtctcaatgtcctgacctcatgatctgcctgcctcggcctcccaaagtgctgggattacaggcgtgagccaccacgcctgaccaatttttgtatttttagtagagatggagtttcaccatgctggtcaggctggtctcaaactcctgacctcagctgatccatcggcctcagcctcccaaagtgccgggattacaggtgtgagccaccgtgcccggccagggatatcttactctcccggcctgagtcctccagaattcagaaacttgttgagtactcttactttcaaagtaatatagttatttgcatagtttcaatgagaatctttgttttttaccaggactggaattggaaatacttcttgtgtaaccaaggccctgcatggaaggccaaatctgagaagacgcccatttagtcagtcaccagcagccacttgtaaggaaccacagcgatgttacagagcccacatccacgaagccctccaaggagaacccggcacagcgcctggcttgtaggatggcaggtgcatctggagggcattgcctggcaggcccaggaacctgggctagtttggaaaccttaagaaaggaatttgctcaaatttatagggcaggtgaaatctggcgggttcttggcttggttttctagcctcaggacagcaagcaagaggcttttatttattttattttaaattatttattattatttatttatttattcttttttttgagatggagtctcgatctgtcacccaggctggagtgcagtggtgtgatctccactcactgcaacctccgcctcccaggttcaagctattctcctgcctcagcctcttgagtagctgggatgacaggcacgtgccaccacgcccggctaattttttttttttttttttttttgtgagacagagtcttgctcttgttgccaggctggagtgcaatggcatgatctcggctcactgcaacctctgccaccctggttcaagcgattcttctgcctcagcctcctgagtagctgggactacaggcacctgccaccatggctggctaatttttgtatttttagtagagacagggttttgccatgttggcaaggctggtcttgatctcctgatggacctcgtggtccacctgcctaggcctcccaaagtgttgggattacaggcgtgagccaccgcgactgccctaaaattattttttaaagaggcttttaaaagtcaatctgaaattctttacggaaacttctaagaaagcaaacttaagaatgcagagatggtgaattagcactctcgctgcacctatggaaataaccaagccatctacaaaccagctccattttgtgagatcaggaacaacctttctgatccttttgtggttcatccgcctgatgattgggttttcatgcagacgtgtgagctgtgcctccctcaagccttgttacaacatccgacatccgcacattacctgtctgatgcccggggaaaaaacacctttctttgagattactttccatcaaaagcagagaaactgtagggaaaaaaaatgagcttccgtagaaactgctttgtctactgcacttccactgggttatctgcgtccagcccctcattgtctttgcgatttgagctgctttgcgattttaccactgataggcatgcggattctgccctgcctgcctctcccctctaccagaaccagttctgcctccatctgaaactcgattcttttactccatgtagatttgtgcttttttgacctttccttggaactggttacagcatctgtccagtttcctcattgtttaatgaacagaatacaatcctaaacaaatgctcatttttcatatttgggagccacattttacttctttctgaaaattatcttttaacgcatagttaaataagtattgctggacacagttaaacctcagtaaggacactgtattatgaaccaggatgagccatagctgtcctgaacatttctgctctaagtaacacagcactgaagttgtgtttgttttttttttttcttgagacggagtcttgctttgtcgcccaggctggagtgcagtggcgtgatctcagctcactgcaacctctgcctcccaggatcaagcgattcttctgcctcagcctcccgagtagctgggactataggcgcgcaacaccaagcccggctaatttttatatttttagtagagatggggatttcactgtgttggccaggttggtcttgaactcctgacctcgtgatctgcctgcctcagcctcccaaagtgctgggattataggcgtgagccgctatgcccggcctagcactgaaatttataaaacatgatggtgagaaggagaaatggacaaaatcacaggagcaatggaggattttaacactttgtggcttttggcagttcaaattgaggagcataaataaatttataaagaatatcaatacgtatatttaatatggttgttaaatagaataaaataaaaagtagtattccgcacatttggtttaataaataaccaaaggaattctgaaattccccctaacaagtagctcgtgaaatagaaaaacagcccacactggccgggtacgtggctcacgcctgtaatcccagcactttgggaggccgaggtgggtggatcacctgaggtcaggagttcgagatcaacctgaccaacatggagaaaccccgtctctactaaaaatacaaaactagccgggcgtggtggcacatgcctgtagtctcagctactcaaggccgaggcaggagaattgcttgatcccatgaggcggaggttgtagatcgcgccattgcactctacaatggcaacaagagtgaaactccgtcaaaaaaaaaaaagcccacaatggcaggctatagagacaatgattacactgacagtactatccctcaaaacctctggggcttggccaaagtgatactcatgaaaactctcaccttaagaaatgcaattactaagcaagaaagaataaaaataaatgtgaaacattcaatctaagaaatcaggagaagaacaataaaataaacacaagaacaaaaagagaaaagatggaatgggaattacttctggtcaagatactgaaaccatccagtggttccagacagcgacctttgaggaaacccctggaaagggggaggggtgctcttacacacacacaggcacacacacacaccccacacgtgcacacaccccacacgcgcacacaccccacacgcacacacacgtgtcagggagcacgtctgacatgccccgtaagatctccagaagagattagacagaaatggaagaaagcagtgtttgaaaaacaatgactgagaattttaaagaatagaaaaacaaccagccaaccaacctaaaatttggtcctaaaatttaaaaaacatacagattcctgagcaggattcagggaaacaaatccacacttagacacaacaatggtaaaacaggagcacctaacagattgggagaaaagtctaaaaacagcttccccaggccgggcgcagtggctcacacctgtaatcccagaacttcaggaggccaaggcgggtggattgcttgagctcaggagttcgagaccagcctggccaacatggtgaaacctgtctctactaaaaatacaaaaaaaaaaaaaaaaaattagctaggctgaacccgggaggtggagtttgcactgggccatgatcatgtcactgcactccagcctgggcaacagacagcaagattccatctcaaaaacaaaacaaaacaaaacaaaaaacagcttccccaaaggcactgagatcagactgatggctgacctctctgaagacataagaatattatcttgaaaagaagttgagccgggcatgatggcatgcatctgtagtcccagctacttgggaggctaaggcaggaagattgctttagcccaagaaatagagactatagtgagctacgatggcaccaccatgccagcctgggtgtcagagcgagaccccatctcttttaaaaaaaaaagtagtagaaaaatgtcaacatacagaaaattctatttccagctaaaccatcattctagaaagtcatctacagatacatagcatgtactccccacagactcttgctgaaggaactgacaaagcaaagggcagagatccctgaataaaagtccatttcccttttctctttcctagaaaagatggggctgccttgtacctgagtctgagtataaagccttgtgtccgatcaactgctctccaggctcctggaagaccccactgtggtaaacagggaaccgaggtcaaggagcaggcctgggaagagcttcaatcaactgtttcataaaatgtgagcaaaagttattacttccaactcaatatattgttataagattttaaatacgtacgtgtcatttaactaataaattaaatgtaaatagatactttactatttatgcacatatgcctaataaagagtattgagtcagctgccaactattgggaaacaacaaagcgagatccctaatttgttctttttcactagatcatttcccgatgcattaaagactcagcaggaaaatgacatgacgataaaatacaagtggccccacagtaagccccctacatacacacaaaattaaagaagcacaaatttaaaacaggaaatccttttacctatttagattggccctccaaatcaattttatttcttttctttttttttttcttttttttttttttgagacagagtctcgctctgtcacccaggctggagtgcagtggcttgatcttggctcacagcaaactccacctctcgggttcgagattctcctgcctcagccgcccgagtagctgggattacaggcacgtgccccaacacttggctaatttttttttttttgtatttttagtagagacggggtttcatcatgttggccaggctggtctcaaactcttgacctcaggtgatcaggcggtggctcacacctgtaatcccagcactttgggaggctgaggtgggcagatcacttgaggtcatgagtatgagaccagcctggccaacatggtgaaaccccgtttctactaaaaatacaaaaattagctgggcatggtggcgggcgcctgtaataccagctacttgggaggctgaggcaatagaatcgctggaacccgggaggcggaggctgcagtgagccgagatcgcaccactgcactccagccttggcaacagagattctgtctcaaaaaaaaaaagttagctatcataaagaagtttactagaaacaacattttaaggaatcccagctttctacaggatcaaggaaatgccatgtgcagctgatttctggaaggcgcagagggagggtgagctccaggcactgcccactctgtgggcagaggggcctgcaggcagggtcccacagcacctgcctcctgcttccccctgcaggcccctgagtggggctgttctcactccccgccctggtctcggccggaaccctgtagcaggcaggtgaagctccttatctcagagggggcccaccatgtcacctgctggagttggctccacagtctgaatggggtgttggcaggaaccagtgtcaccagagcacaggggacgccccggcacctccccccacagccatctatatgggcaccggcagcatgagacaggctctatgcctgaaagcagccgagagccagtgaagtggcggtcagcttgctccctgcgggatgcggccccttcccagaggcggacaggtgaggacatgcactgaggcagctgcaggtgacccctgggccaccggtgctggggcagagtagctgttgtgaagtggactagagaagcatctagaaacagccacaggcagagcaggtcctgctcagccccctggctggacggctgtcccacgttgaataatgatgatatgtttgtcacagctggccattctgtactacttaatgattgcagccacatcatttatgaaccggataagtgatcttaggaaaaaaatgcagatagaccagtcagtcttgcctaaacctttgcaatcaggactcatcttttttatttttttaaatgtttttagagactggatctcctgtgctgcccaggctggagtgcagtgattattcacaggcaggatcatacccactgcagccccgacctcctgcgctcaagcaatcctcccacctcagtctcccaagtagctggaacttcagacacacaacaccatgcccagctaagaactcaatgtttaggtggggaggacggccttcccaaaaagaaacaaatggggtatgtttggtataatcaaagccaaaccaaaagtccccattcttctcttctcactctactttcttctctaaattgccaataaatcgacaaacttccattgagtcctccctatggatgtgtgcatgcatgcacacacacggtctaacatacaaatgcatgtgtgcacacagtctcacatacaaatgtatgtgcacagtctcacacacaaacgtgtgtgcacacagtctcacatacaaacgcacatgcacagtcttgcacacaaacgcttgtgcagtctcgcaaacaaacgtgtgtgcacacacacagtctcacatacaaatgcacgtgcacacacacagtctcgtctcgggaagtgctaggattacaggcgtgagccaccacacacagccgaggaaacatctctttagccagatttgggcctggcgacataggaactgaagaaggcagaaagtatctggcactcagcaggggctcctctactggatgggtggatggatatatggatggtaggtggatgagtgactggatgattggatggatgggtggatgggtgagtgaaaggatggataggtgggtgggataagtggttggataaatggatggataggtgggtgcatgggtaggtggatggatggatggatgaatggatagatggatgaatggatgggtggatgcaaagatagatgaatggatggatgaatgggtgggtgggtgggtggatggatgggcggatggatagatggatgggtgggttggtggatgagtgagagtggctaattggatacatgggtggatagatgaacagatggatgggtgggtgaatggatggatagataagtgggataagtggttggatggatagatggataggtgtatggacggatggacaggtgagtgtgtgggtaggtggatggatagatgggtgggtggacggatggatggatacattaatagatggatgggtgggtgggtgtacgaatggatggatggatgggtgggtggatggatagatggatggatgattgggcgggtgggtggatggatgggtggatggatacatggaagggtgggtgggtgaatggatgaatgggtgggtggatggatggatggatagataggtgggtggatggatgggtgggtggatggtagatggatggatggatgggttggtgcgtagatggatagatggatgggtgggtgggtgggtgaatagatgaatgggtgggtggatgggtagatggatggatggttggatgggtgggtgaatggatgaatgggtgggtggatggatggatggatagataggtgggtggatggatggtagatggatgggtgggtgggtggatgggtagatggatggatggttggatgggtgggtgaatggatgaatgggtgggtggatggatggatggatagataggtgggtggatggatggtagatggatgggtgggtgggtggatggatggatgggtgggtagatgggtggatggatggatgggtgggtgggataagtggttggatggttagatggatggatggatggatggatggatggatggatggatggatgaatagataggtgggtggatagatgggtgcgtggatggtagatggatggatggatgggtgggtgggtagatgggtagatggatggatggatggatggtagatggatggatgggtggatggatacatggatgggtgggtgaatggataaatgggtgggtggatggatggatggatggataggtgggtggatggatgggtggatgggtgggtgggtgaatggatgaatgggtgggtggatggatggatggataggtgggtggatggatgggtgagtggatgggtagatggatggatggttgggtgggtgggtgggtggatggatgggtgggtggatacatggatgggtgggtgggtgaatggatgaatgggtgggtggatggatggatggatagataggtgggtggatggatgggtgggtggatggtagatggatagatggatgggtgggtgagtagatggatagatggatgggtgggtgggtgaatagatgaatgagtgggtggatgggtagatggatggatggttgggtgggtgggcagacggatgggtggatggatacatggatgggtgggtgggtgaatgggtgggtggatggatggatggaaagataggtgggtggatagatggtagatggatggatgggtgggtgggtggatggatgggtgggtgggtagatgggtggatggacagatggatgggtgggtgggataagtggttggatggttggatggatggatggatgaacagataggtgggtggatggatgggtgggtgggtggatggtagatggatggatgtatgggtgggtgggtagatgggtagatggatgaatggatgggtggtggatggatggtagatggatggatgggtgggtggacggatggttgggtgggtggatggatggatgggtgggtgggtagatggatggatgggtagatgggataagtggttgcatggatggatggatggatggatgggtggatgaataaataggtgggtggatggatgggtgggtggatggcggatggatgagtgggtggatgaatggatgggtgggtgggtagatgggtagatggatggatggatggatggggggggtgggtgaatggatggatagatggatgggtggttggatagatggatggataggtaggtgggtggatgcatggaggaacagatggatgactcactgaaacactcagtcataaagccagtgccccttgcctttcttaggaagtcagctccggtgtctgtgtccaagatgcccagcctccacctcagtcaggagacactgctgcctttacctggagaagtctgcggccatcttcgctgctcaccacagagccgcacagaaatgccggctgctttgctaacctgcggtgttgttctcacaaatgctgccagcgaagtgggtccccagagcgcccgcagctaagatgaggtcctgctctgtgcagtggcctccgaccaggccccgctcacaagaggggcttctgtgctccttcgggccttcctgagaaggctgcgtccagagccctcccactgaccccaggcgcacacccagaacctgacccgcacccagaaccaggcgcacacccagaacctggcccgcacccagaaccaggcgcacacccggaacctgacccacacccagaaccaggcgcacacccagaacctggcgcacacccggaaccaggagcacacccagaacctggcgcacacccagaaccaggcacacacccagaacaaggcccacacccagaacctggcgcacatccagaaccaggtgcacactcagaacctgacccgcacccagaaccaggcgcacacccagaaccaggcgcacacccagaacctggcacacacccagaatgtgacccccacccagaaccaggcacacactcagaacctggtgcacacccagaacctgacccacacccagaaccaggcgcacacccagaaccaggcgcacacccagaacctgacccacacccagaaccaggtgcacacccagaacctgacccgcacctagaaccaggcgcacacccagaaccaggcgcacacccagaaccaggcgcacactcagaacctgacccgcacccagaaccaggcgcacacccagaacctggtgcacacccagaaccaggtgcacactcagaacctgacccgcacccagaaccaggcgcacacccagaacctggtgcacacccagaaccaggcgcacacccagaaccaggcgcacacccagaacctgacccgcacctagaaccaggcacacacccagaaccaggcgcacacccagaacctggcacacacccagaacctgacccgcacccagaaccaggcgcacactcagaacctggtgcacatccagaacctgacccacacccagaaccaggcgcacactcagaacctgacccgcacccagaaccaagcgcacacccagaacctggtgcacacccagaaccaggagcacacccagaaccaggcgcacacccagaacctgacccgcacctagaaccaggcacacactcagaaccaggcgcacacctagaacctggcacacacccagaacctgacccgcacccagaaccaggcgcacactcagaacctggtgcacacccagaacctgacccacacccagaaccaggcgcacactcagaacctgacccgcacccagaaccaggcgcacacccagaacctggtgcacacccagaacctgacccacacccagaacctgacccgcacccagaaccaggcgcacacccagaaccaggcgcacacccagaacctgacctgcacctagaaccaggcacacacccagaaccaggcacacacccagaacctggcacacacccagaacctggcgcacacccagaacctgacccgcacccagaaccaggcgcacactcagaacctggtgcacacccagaacctgacccacacccagaaccaggcgcacacccagaacctgacccgcacctagaaccaggcgcacacccagaaccaggcgcacacccagaaccaggcgcacatccagaacctgacccacacccagaacctggcacacacccagaacctggcacacacccagaacctgacccgcacccagaaccaggcgcatacccagaacctgacccgcacccagaaccagatgcacacccagaaccaggtgcacacccagaacctggcacacacccagaacctggcacacacccagaacctgacccacacccagaacctggcgcacccccagaatctgacccacatccagaacctggtgcacccccagaatctgacccacatccagaacctggcgcacacccagaaccaggtgcacacccagaacctgacccacactcaggccatggcctccacttcccggactcactttcgggtcggcccagctctgcacggagcctgttccccatctcgatgagctgctctttctccaggcggaggctgatgatttttctggctgcctccttcagctttctctggagtcggtgcatagataaggtctggggggcacgtgccactgaccggaggtgcaggaaaagctccccctggtcctcggcctccataggccctctcttggtgaggccctgtaacaaaactcacaggcagacacccctgtgaggctgccctcatgggaggacgccaggggtgcccacccaaggagcctcttcacctgctcttccagggtgggcactgctggctgtcactgggtgacatccttccaaaagaaagacaaaaagagtcgctgctcccagtgcttcagtgggttccttctcttccacaaatagaataaaggcccacagatctcccaggccagggtggcccccagatctcccaggccctcacagccctccgcctcctccccgccatccctgccttctggtcatctatgcctttgtgtctttcaagtgaacacaaggagaatctgaggacacccaaccagcacagcagctccccagggagagcagagagaaggctgtggcctccagcagtgcccaggacccaggaaggcggcccagggagagcagagagaaggctgtggcctctagcagtgcccaggacccaggaggacagctcccgccagcgtggcttggccctcctccactccttggggtccctcctttctctacctgccagctggacaccccacaaccaccctgcaggccggctgtggcttccctcctgaagcaggtgcagggggagcacaaaggcagtggagagggaggaggccgacacaggggcaggagctggctgggctcccccttagcaccccaagcctgggtcaaccctagatctgagcccctgggaagcactgtgttgtcctcactcagcccaacctggacttgcagcccacatcattccagtgctacagagtgcaatcccaacacaaagggatgcctggaccaaaaatgggggcacaggaaaaagcagtagtgtccaggccctggcaagacgggagccgacgacctacttctcccgtgccactcctggcccctgtaaggagccaggctgcacctggccctggccacatgagctccgagttcctggaacaggccagcacaccctgtccccgccagcttcctggtgtgcctttccagggctggcaggtgctgctgccttccaggtgctgctgttctttggatggcctggggtgcagccactgtatgcagtgcctccgggcatgtgccgcaggttcatgtgggacgctcgggggccgcgggggatgacacatcgaaggggagagatgtctgctttcctcttggacagagaaagttctatggtgccgcaggccccagctgaggacgggtgcagggcagcccccatgaaggctcgccacaggcctgagcccgagtccagactcgcttcctccagtaagcgggcctcatgcctgctccgtgagcacccttggcaagtgtggtgcagaggctcactcaccaccctgggagaatagacaggaatgggctcttgggtgtgggagaggccaaggcagagggagaggaagggaggcctgtgctggtaaaacagattgcagatggcctggggctgggggagaggggccaggcaggtgagactcgcaagtccggttctaaaaccctggatcctctacaggaacacactgggttattttgttattttaactgaagaaagaacaatcccgaaaacagattttgcaaacctcaaaacacttagagatttaagagaaaattccgtcttcaaaagcagtcccctctccctgcaaagttacaccaggccctgcggctggtgccaggcttgaggggcactgaggggccttcttgctgttgaccccacaggcaaaggaaggagggcatggatcacagggcccatgtcctagtcacgtgattctgcacacagtgacctggggggcagggagtgaacgattctacttctctcggattcagtttctggtaaaatgttatttggtaaaagtttattttgatgattctctaaaatctttccacaaaataagatttctacagcctgagacatattcaggaatgtcttcaccactgtgtgctccaagggctgcccacccccagcagggcagcagcagctgtccacccatctgcccccacgcctaggactgccccagcaccccacaggtgaggaggagatgtctccaagtatctggacgattcgaagaaaattcgaaggaaactttggtctgctgaaatgtcttcacgtcctgaggacatgtatgagtgagtgacacagggaagtccttctcagaggctgaggcctgggcctggtacagtgggttccatcaggctgggccggcgctcaccgccccacacagccactccaacgcctctcggcagagccagcaccaacaccatggccaacactgccccccagtggacccagggatgtaacacatcccccaactcagccctggcggccagtgactgggggaagttttgtattttaagggctagaggcagctgatgtgggtggtgcagtcagggaagcccaaagccaggctgtgcggctcagcccagtgggacctgcctgggagcagagtgccccactgttgtccacaggctctccctctgccatgggagaagtgggaacacgtgcctccgcacacacctggtcccagctttgcagacctggctccttggctagggccgtggaaggggaccagctttcgtcaggagtgctgtgggacagtccctggacccctgtgcacttcctcacccaccctgcactggcttcctgcactacaggaggtaggctggagacgcagtgccgcgtcacacctcagtacttgggtgggtgtacacaatacgtgacctggtccgtggcccgtgtgcaaatgtcaccaaccgtccagataacgccctgacgccatctctcctgtgcagggtccagggtcccacgtggcatttctacactgtctctcctgtgcagggtccatggtcccacatggtgtttctacagatgatgccctgacaccgtctctcctgtgcagggtccagggtcccacgtggtgtttctacggatgatgccctgacgccgtctctcctgtgcagggtccagggtcccacgtggcgtttctacggatgatgacttgatgcccgtctctcctgtacagagcccagggtcccacgtggcgtttctacagatgatgccctgacgctgtctctcctgtgcagggtccagggtcccacctggcatttctacatggggtctcccaggtctcctaactggagtggctccccagcttccatgtttgggcactcgccaagcatctagacccgctcatctgcagatgtccctctgtttgggcttgcctgaggtctcctcatgcataagctcaggttctgcatttttggcagggaccccgagcgcgagtctgtgccgtctcagtgcgacccgcccagaggcgcgtgacacgggcgcatcccagcactggcgatgggagctctgatcactcgggtcagctggggtcaaacaggctgctccactggaaagccagcatttcccttggaaataagaagtcacgtgtggggagatgctgcttcgcatccgtctgatgggaatccctctggttcagcacccatccgtggtcgcccggcgcgccgttcctgtcgcgttccttggctggcactctcgcgtggaagagtgccccgttcccctgaccgatctgtccattgctatcagcctggacccatgatttcctggttgagtcagtggattgtggtcttcaacgtcactgcctattggcctagttctggtccttggggacccctttcagctgcttcctgtgccttccgaacctgcctccatgctagagcccgggctcctgtgagcagggcaggaaccatggaactagcgcctggaactgtggaactggcatctgctgtggctgagtccgggctgtgggccctctcaggacagagctgggatcagatgcacatgcagctctacccacttctctctatacccaacataacggacacattgatcctctacctgagggtccagccccaacatggccccttctccgtctgggctcctttcccagcagcaagcagcaaggacctgggcccgccctcgtctccaggagctcagccatgctgcttggcagaggacagagcccaggtgggcctcgcctgggtggagagcccggccacaggatgctcagacccaggaggagcctggagcccgactgtcgcctccatgcatgtagacacagagcctggagtgtatgccccgcctgtgccttagctccaataactgggattgggctgcaggtggcttcatctctcaatttaaaattctgcttatttgggccaggcacagtgggccactgtgcctataatcccacctgtaatcccaccactttgggggactgaggcaggcagatcacttgaaaccaggagtttgagaccagcctggccaacatggtgaaaccctgtctctactgaaaacacaaaaattggccgggcgtggtgcacctgtaatcccagctactcagggggctgaggcgggagaattgcttgaacccgggaggaggaggttgcagtgagccaagatagcgccagtgcactccagattgggcgacagtgtgagactctgtctcaaaaaaaaaaaagaaagaaaaaattctgcttatttgtataaattcttgccccttcattctaaacaagtgggaagacagtgaactacgcaagggccaacagtgagagctcctggggccccttgctgcccaaggaggcgcccgcccgtgtccgggaacacatggcgctcaggtgggtgggagatgtgtgggggtacagacatgcttacccctggctgtgctgccagctggcccaagggccacagcccccaccgggcaggagccaccctggagtggctggactgggagcccaggagggctagggtgctggagacccctgaggacaagacctccttaccaacaggtacaggggcaggtgcagctcaatatcttaccgaccagctcagcccttcctgtgcgcactggctgagcacctgctagggcctcaggctccctcggccttcccatacctgccctgttgtacccctgaggcatccttatggtcttgcccatcccatgccaaggcagctctggcctgctcctcactgtcctggagcctgagacagccacggccgcatcttcctcagtccactctattccagcctgagtccctggggatctgctccccaagcacggtgccctggggatccacgctgtcttccactttgtgctttccagacatcatctactgtccccaaaaccttctgtggattcataggtcactattggtaactataggttaccacaggtcataggtcactacagttatcccagttaccaacagtctagggtacgaagtcagggaggccgggcagcctgtccttcacagcctttccctctggccttaggtaggaagaagggggccctgctggtcggctctgccaagctgcagaatcaggacctggggtcgtctccacagctcagagctgtggctcaaacccagccatggagttgggggtcactccctcggggccaagggcctgaccaaaaccaggataggagtgccatggcctggagcagctgtgtggctctgaacgcagcagtgagggccatgtgggcccctccccacgcagggagggcccaacgctaggcatggggcaggcatggctgtgcacgcagacgccccctcagcaggccgtcaaggccctgcattaaagcaaacatgagccaccttcagtgtgtgcgtttccaacacaagatgctgttagctgaagggaggactgggatgggcccgtcccgccccccaccaacggggcatcaaggtgaaggaccaggagaagaggaggcgtgtggaggaagaaggcggaggaatggggagagggggtggagcagggcccacttccaggcacggccttcactgcagccctcgtcccacctgagctcccagggcatacagacagcaacgctggcagagcacaggcaaggacggtttctgtggcaggaacctcggcgggtggcaggaggagctagcgggcacccacctctctcccaagggccacggcgtccgaggctgggggctgcttcctgcctgaaggctccgctcccccgtgctgggctatcctgagatgcttccccagctcagccacctgcttccgcagctccaaaacctccaggtgtacctggtccacctcacggggaagctcacgctggagagcggccggctccaggggttcccgcagcacctaggggtcatttcaaaggcagtgtgaggaatgaggcagtggctgggctggagcaggcccctgggcactgacaggaagcgctgtgagtgccgggaaagaacggggagcccggggtcagggcctcctccccagctggatgcaactgccctcagccctctgcccccaaccacggccactgctcctcctgccccgcccagctggccctggcagttcccctgtgccctgctctggactcctaggctggtggggagaatccgtgcatggactgaggcagagcgcctcgaaaccccttcctgagcctcctcccagggagaaacaaaggcctccagaattgcaagtaaccggtaggaggtgttgatttttcttttctgctaatcaaagggggcagacatggggaggccagaggtaaacaggccaggaagtcggagggctgaggctattgaaaggcaggtggataggctgggtgcggtggctcacgcctataatcccagtgccttgggaggccgaggagggtggatcacgaggtcaggagatcgagaccatcctggccaacatggtgaaaccccatctctactaaaaaataaaaaaaattagccgggcatggcggtgggtgcctgtggtcccagctacttgggaggctgaggcaggagaatggcatgaacccgggaggtggagcttgcagtgagccaagatcgcgccagtgtactccagcctgggcgacagagcgagactccatttcaaaaaaaaaaaaaaaaaagcttgtattaatttttatttatttacttattttattcagacggcatcttagttggttgcttaggctggtctcaaactcctgggctcaagcgatccttctgcctcagcctcccaaagtgttgggattacacgtgtgagccaccgcatccagcctatttctatttttagagacagggtcttgctcttcgcccaagctggggcagagtggcgcgatcgtggctcgccgcagcctcaaccatctgggctcaagcaaccctcccactgggctcaagtaatcctcagcctcctgagtagctgggactacagacgcaccaccatgcttggctaattatttcagtttttattacagatggggtcttgctgtgttgcccaggctgatttcaaactgctgagctcaaataatcctcccacctcaccattccaaagtgtggggattacaggcatgcaccaccgtgcccagccttgtttagtttttgtagggacaaggtctccctatgttgcccaggctggtctcaaactcctgggctcaagtgatcttcctgcctcagactcccaaagtgttgagattacaggtgtgtaccaccgtgcccagcctaaaagctgtatttaaatgtttatttcttgtctgtagcatttgtgcgggaaatgggggaaacagcaactgcaaagcatcggggatctggagccccttcacgggcacatggatcttcaactccctcgactggagcccctcacgtgtacatggatcttcaactgcctcgacagaaatggaaaagtggccaagttcctctccattgcaacaacaaggacacacttccaatcaaggcgaggcgttaggcatcagcagaaaatgagaggtatgagggtaacgcacatgttaattagcctcatttagcccttccagtgtgggcatgtttcaaaacatcatgtcgcataccatagagatatacaatttatatttgtcattttctttttttttttttttgagacggagtcttgctctgtcgcccaggctggagtgcagtagcgcgatctcagctcactgcaacctccgcctcccgggttcaagcaattgccttgcctcagcctcccgagtagctgggattacaggcacgcaccaccacacccggctcatcttttgtattttagtagacacagagttcatcatgttggccaagatggtctcaatctcctgacctggtgatctgcccatcttggactcccaaggtgctgggattacaggcgtgagccacctcgcctggccatatttgccattttcaatcaatccatcaaacatcttaggaagattaaaaaaaaaaagcatccaatttctggagcactgtgcactccctgggcagatgggaaatctggaatactttgtttctagagagatgttctgcgttagagaagaagcagaggctgcagggaaggcgtggtttatgtatttacaatgcgagaggacatgtggaagttcccttgttatgtcgcctcacaaggaataaaagcaacaggatgaggacagcatgactcagaagcacaagcaacaggagacatgatcaacaggactggatcaaaactggaaacattcggtgtccttcaaaggacaccatcaggaaagtgaaaagacaggccaggtgcagtgactcatacctgtaatgccagcactttgggaggcagacaggccaggtgcagtggctcatacctgtaatctcagcactttgggaggcagacaggccaggtgcagtggctcatacctgtaatcccagcactttgggaggcacacaggccaggtgcagtggctcatacctgtaatgccagcactttgggaggcagacaggccaggtgcagtggctcatacctgtaatcccagcactttgggaggcagacaggccaggtgcagtggctcatacctgtaatcctagcactttgggaggcagaggtgggaagatcacctgaggtgaggagttcgataccagcctggccaacatggtaaaaccccatctctaccaaaaatacaaaaattagcaggcgtggtggctcatgcctgtaatcccagctacttgggaggctgaggcaggagaattccttgaacccgggaggcggaggttgcagtcagccgagatcacgccattgcactccagcctgggcgacacagcaagactctgtctcaaaaaaaaaaaaaaaaaaaaaaaaagagaaagtgaaaagacaaaccacagaatgggagaaaaatgtagcaaatcatatatctaataagggacttgtatctggaatataaaaagaattcttacaactcaaataaaaagacaacccaattaaaactgggcaagggatccacacggatgtttctccaaagaagacaaatggctcaaatggctgaccaagacgcacatgagacgatgctcgacaccaggagtcatcaggaaaatgcaaatcaaaaccacagcgaggccccacttcactcccaccaggatgcctagcatcacagccagaaaacagctagtgttggtggggatgggggaaccggaaccctcacacagtgctggtggaggtaaaatcgtgtggctgctggggaaaacagtgcggtggctcctcagagggttaaacacagagttaatgtctggggaaaacagcacggtggctcctcaaagggttcaacacagggtgaccgtctgacagagcaattccgctcccaggtgtacacccaggagaactgaactctgcataagtccacacaggaacttacacaggaacattcacagcagcattatgcacaatccaaacagcggaaacaacccaaatgttgagtgcatgaatgataaacaaaatgtgattcctccatacaatggaatatgtcagccatgggaaggaatgacgttctgacatatgcagagctgaaccctgaaaacattctactcaatgaaagaagccgggcacaaaaggacaactaccataggactgtgttaatatgaggtccctacagtagacaaattgattgtgacgggggtggaatacttactagaagctgggaagcagggaaggggtgacactgctgtgtggttattgtaccgagcttctatctggggtggggagaaaagctccggtaatagtgagaatgtttatgcgacattgtgaatgtgcttaatgccactgaaaggtacactttaaaatggccaaaatgaatagtgagaatgtttatacgacattgtgaatgtgcttaatgccactgaaaggtacactttaaaatggccaaaatggtaaactttgttatatattaatgaattttaccacaattaaaaaaattttttttttgagatggagtttcgctcctgttgcccaagctagagtacaatggcacaatctcggctcactgcaacctccgcctcctgggttcaagcgattctcccacctcagcctcccaagtagctgggactatgggtacccgccaccactcccggctaattttttgtattttatagagatggggtttcaccatgttggccaggctggtctcgaactcctgacctcaggagtggggtgatccgcccacctcggcctcccaaagtgctgggattacaggtgtgagcccccatgcctggccacacaattttttaaagtaaaagccaaaacgatgttaggaatatgtagcagtcaaaccgaggtagtgaccccagccccatgggaaacagggtgggctcgctgctggatgcagatactggtcccagcaggagtaggacccgacccccaaaaggcaagggcccaggaggttgaaaagaacagcgcttgccggggccctagtatctcagatgaagtgtggctcaacactgacatggagcacatgcgtccggttgaccaggacccctctgagcgggcaggtggcatcgggcagcccgcacacacgccccactgaccaggacccctctgagcgggcaggtggcatcgggcagcccgcacacacgccccactgaccaggacccctctgagcgggcaggtggcatcgggcagcccgcacacacgccccactgaccaggacccctctgagcgggcaggtggcatcgggcagcccgcacacacgccccactgaccaggacccctctgagcgggcaggtggcatcgggcagcccgcacacacgccccactgaccaggacccctctgagcgggcaggtggcatcgggcagcccgcacacacgccccactgaccaggacccctctgagcgggcacagccagggcctggtgttctggccgccagtgctgcctccactgcctagaccatgcttcccaggttctcatggcacgccttccacgagcacacctgagatgaaccggttcctaggacctccccacagccccttcctcagaaaaaaacaggcagagagaggtcagtggatgcccgaggtcacctggggtcgcaccgggcagccgctcagagcccacgcgctctcccccagcagcggctctctaggaggatgaccccacaaacttgactgcctcaccttctgtctgagtcgtgtcaccagcaggtttaggagctgcactctgtccccgagcttcctgagtgccagtccagaggatactgggccagcttggacagatcctcctgcttgaccagcttggacagaccctccggcttgaccagcttgggcagaccctcctgcagagaagagtggcttctgtcagctcatacctgagaacaaaggaagacctttctggggagacacacatctctatcagctctccctttcccgtgaggccatggcaccagcggctgaccccaatgcgaagctgttcttcattggagtcagcagatctggtccacgtgaagattagagatgctgtacagaaagcataatcctcatgtaaagaaagcaagaatccttgtaggaaaaagtctgaccttaccacgtaatgtctgatagagaccaattgctccagtctgtccaagtaaagagccacttgcttggaaatgaagaaaaaagatgccacataacacagggtcaaagaaaaaaatcacaatggacattaacaactattttgaatggaaagataacaacaatactaccttagaaacttcaggaatgaatctaaagctgtccttccaagaataattacagctttagataaatattttagaaaagaagaaaggccaaaaaccaatgagctaaacattcatctcaagaaattagaggggccaggtgcagtggcccatccctgtcatctcatcacgttgggaggctgaggcaggaggatccctcgatcccaggaattcaaggttacagtgagctatgactgagccactgcactccagcctggataacagagcgagaccctgtcacacacacacacagaaaaataaatttaaaaagaatgaccaaattaaagccaaatagggccaggcacggtggctcacgcctgtaatctcagcactttgggaggctgaggtgggcagatcgcctgaggtcaggagtgggagaccaacctggccaatgtggcaaaaccctgtctctgctaaaaaaaaaatacaaaaattagccaggcgtggtggtgcgcccctgtggtctcaactactcgggaggctgaggcacgagaatcgattgaactcgggaggcggaggtggcagtgagccaagattgtgccactacactccagcctgggtgacagagtgagactctgtctcaaaaaaaacaaaaacaaacaaacaaaaaaacgccaaataaagtaggaggaagaaaagataacgttagtattagatactgaggaaacagaaaataaatgtataatagagaatcaacaaaatcaacagttgattctttgagaaggctaaaataaacacccaataatactaagcaaggaaaaaatagaagcaaatgaccaatataattaatggcaaaaaggagtcaacacttcagatcccacagacatttaaaaactcataggatactataagcaactttatgtcaaaaatttgaaaatttagatgaaatggacaatttcttagtaaaatataacatcaaaaatgtacaaaaaagaaaatccaaatgtcctacaactatgaaaaaaactgaatacacaattttaaaccttcccacaaggaaaactccaggcccagctggtttcaaagttgaattctaccaattatttaagaaaaattaatataagtctgatacaaacttttttagaaaacggaaaaatagagaatactttccaacatatttatgaggccagcgtaactctgattccaaaacctcccatgaacattatgagaattgaaaattatgggccagtcttactcatgaacataaatgtgataattctcaataaaacactggcaaaccaagctgggtgtggtggctcacacctgtaatcccagctacacaggaggccaaggcaagaagatggcttgagcccaagagttcaagaatagcctggtcaaagagcgagactgtgtctcatttaaacaaaaaacaaaagaagtatcagcaaaccaaatctgtcaaactataaaaagaagaatctatcactacatgttgaattcatcccagaactgcacgggcggtttaacccgacggagcccctacagtccacccgcattttgcctgctaatctcagctaaaggcccagccagaacacaaaaagcctcactaggggaaaattctgaacagtgagaaatgaaggctgagtgtctaggggcctcggatcccaggggtggctggcaaggagtccctcgtctccttcctgcacacactggcctggtgctaggcagccacaacccagagctcagaccaaaaaaaaaaaaggccgaagagaagctgctcctgggaccaacggagcaagaagacggggacgtgcaggtggagcccttgggaccacacctgccctcctgccagcccatggtcctgcagcctgctgtggacaaaggccagctgggcttctgggagagcatgtggggagggtcacaggaggaaggaggtctgcgtgaagacccctgaggagctgccgtgtaaaaccagccagaatccacagaaccagcacagcaaaacctctgacaaccgggcctggcgggggacactgcccaggatttaactggccacttggtagctcatgtatgggcagaggaaaatagcatcatcaaggctctggaaagtaatggacattcaaacctcagcccaccagagcgggccaggatgcgcagtgtgaacccagaaaggctgactacctgacaaaagaaaagacagaattaacatagatttaataagaactggaatttcataatgtgacactcaaaatgtccatgatacagtaacaaattacaggaggctgcttgtaattccagtactttgggaggccaaggcaggaggatcacttgagccaaggagttttgagaacagccttggcaatatagtgagactccatctctgattaaaaaaaaaattactcgtcatattaacaaccaagaaaatctcaatgtgaatgaaatagacaacaccaagatgacacagacattggaattatgggatgaagattttaaagcagcagtcataacaaaactccagcaagttactggggagggtagaggtgagagaattgcttgaagccaatagtttaagatcagcctgggcaacatagtgaaaccccatctctacaaaaaaaaaaaaaaaattagctaggcatggaggtggtatgtacctataaccccagctcttcagcagtctgaggcaggagggtcacttgagcccaggaggcccaggctgcagtgagccatgataatgccgttgcactccagcgtgggtgacagatcgagaccctgtctctaaaaaaaacaaacaaatacacaaacaaaaaactccagcaagcaatttaatacactctaaaacttatggcaaaatgaaagttccagtaaagtaagatataaagaaaactaaggccaactgtgatggctcatgcctgtaatccaaacactttgggaggctgaggcaggaggatcaattgaggccaggagttcaagaccagcctgggcaacatagtgatactccatctctacaaatataaaaagaaattagctgggtgtggtggtgcacacctgtagcctgtagtcccagttacttggcaagctaaggtgggagggtcccttgagcccagggggtcaaggctgcagtgagctatgaccatactaccacactccagactggacaacagagcaaggccctgtctcaaaaacaacaaccacaacaacaacaacaaaaaaaaaggaaaaagaaacccaaaatggaaattttagaaacagaaacaaaaatctcactgaatgggctccacagcaaaatggaaatgacaaaagcaagcactgataaacctgaagaacagaggaaaagaaactgtccaatttgaacaagagagaaaacaaattgaaaagaaacaaaacacagcctcagggaccagcaggacaataacaaaagaccaaacgtttgtgtcctcagagccccagaaggaaagagtgtggagccgaaaaaattacttgaaaaataatgaatgaaaacttctgaaatttggtgaaagacataaaccttcagatcaatatcaaaaagaataaaccaaagaaatctatgcccagatacaacataatgaaatttctgaaaactaaagacaaaaattcttttttttttttttgagatggatttttgctcttgtagcccaggctggagtgcagtggcgcgatgtcggctcactgcaacctccacctcccgggttcaagcgattctcctgcctcagcctcccaaatagctgggatcacaggtgtccaccaccatgcccagctaatttttgtatttttagtagaaatggggtttctccactttggccaggctggtcttgaactcctggcctcaagtgatccacccgcctcagcttcccaaagtgctgggattgcaggcacccgcaaccacacccggccaatttttgcatttttaataggggtttcaccatgttggtcaggctagtcttgaactcctgacctcaagtgatccacccacctcggcctcccaaagtgctgggattacaggtgtgcgccaccgtgcccagctaatttttgtatttttagtagatacggggtttcgccatgttggccaggctggccttcaactactgacctcaggtgatccacctgccttggcctcccaaagtgctgggatgacaggcatgagccacggcgcccggcctgtcaacgtaattttaagagttaagtgtgaaagaatgtctatcatattcatccttgccattagttttccttcactcctgacattcctagtttccttccttctgttgtgtctaaagtacctcctttatcagttcttttagatccagtctgctggtgacaaacttttccttcatctgagaatgtctttattcactctcattcctgaagaatatttttactgaatgtataattatgggttgacagttttttgctttcagtacttgaaaaatattatgccacttccttctgaggagaaatctgatgacagctgctgctgagaacccactaccgctccagtcactgtcccctgtgggctgtgcatcgctctctctgtgtgctttcaacagtttttgtctttaggccgggcgcagtggctcacgcctgtaattccagcactttgggaggccagcgcaagtggatcacctgaggccagaagttcgagaccagcctggccaacatggtgaaaccctgtctctactaacaatacaaacgccaccagctgggcatggtggcacatgcctgtaaccctagctactttggaggctgaggcatgagaatcgctcgaacccaggaggcagaggttgcagtgagccgagattgtgccactgcactccagcctgggcaacagagactccgtctcaaaaaacaagaaattcatttcaaatataaaagagagaggtaggtaaaaagaaaaagggatgaaaaagttataccacgcgaatgctaatcaaaagaaagcccgagtggattaattaatatcagacaaggtagacttcagaacaaagaatgttgccagacaaagaggaagattacgtaacaatataagggtcaattatcctaaaaaaaaaaaaccctaaatgtatacacatctaacaacaaagatacaaaatatatgaaacaaaaacaaagaatcgtgatttaaaaaataaagatctatattaaaacaggaatagaaagaaacttccttaacctccctccactacccccaccacaaaaaaccttcagcaaaaactcaacctaaaaaagtgaaatgctgaaagttcttcctctgggattagggagaaagacagctattatcaacatcataccggagagtttagctaggggcgataatgcaagaagaagtaaacaatatcagcattggaaaagaaaaataaaacctcccttattttattttactttattttttttgagatggagtctcgctctgttacctaggctggagtgtagtggtgcaatctcggctcactgcaacctccgcctcctgggttcaagtgattctcctgcctcagcctcccaagtggctgggattacaggtgcctgccaccacgcccagctaatttttttgtatttttagtagagacggggtttcaccatgttggccaggctggtctcaaactcccgacctcaggtgatccacccacctcggcctcccaaagtgctgggattacaggcgtgagccactgcgcccggcaaaaacctcccctatttgagacaatctgtgccagtggagtgtcctgtctggcccctccctttcttttcctgccttaggcctgcagatggggcctgcctcccctacactaaggggggctgtggctccagcagggtgaaggcatctgtgtggaaggcagccaggctgggctgtcaagctcggtgatgctggggaggcatccaggcaggagaggggcctgcaaataggggaaggggccacagcagcaatgggggattggttacaccaagaggactcgatcaaagtaactgtgttagtgataatgggcgagccaggtttctcattattgggaaaggaagttagaataatgaaaaagaaagctagaatgctagaatgaaccttttgatgttggactaaccacaatggaatagattagcctatgagtttgtcttgaaattaagaccttccattcaccaaagacaccagtgaaggaataaaaggcaagccatagactgggagaagatatttgcaacacatataaccaacgctaggctcatattcagcataaaataccctaaaaaaatctatgacaaagggcagatgatccaataaacaatgggcaaaagacatggcctggagctccaaaagaggggctgtcgaaaggccaattctatggactgagctctgccccccaaaatttacgggttgaagctctcaccccgaacatgactgtatttggagacagcgcctctgaggaggcagctaaggttacatgaggtcctaaggctggggccctggactgttgtccttacaagaagaggaagagtcgggcgcggtgtctcacgcctgtcatcccagcactttgggaggctcaggtaggcagatcacgaggtcaggagttcgggaccagcctgaccaacgtggtgaaacctcatctctactaaaaatacaaaaattagccgggcgtggtggcatgcacctgtaatcccagctactcaggaggctgaggcaggagaatcgcttgaacttgggaggcagaggctgcaatgagccaaaatcatgccactgcactccaccctgggcaacagagcaagactctgtcccaaaaaaaaaaaaaaaaaagaggaagagacaccaggagtgagcatgcagcgggggaggagtcacgtgagcacgcagggggagagtccacatgagcacgcaggggagagggtgccgtctgcaagccacagagaggcctcaggaggaacccaccctgccggcaacctgatctctgacatccagactccagaagtgagaaaataaaaccgttgtttaagccactcaggctgtggtgttgagttacggcagccctagccaatcatacgccaatgcacacaggaagagatgttcaatcccacgaatctcatgaatttgcaaattaaaccaaaataggatgtgctacgtgtccactagagggaacagaaggagccgctgaccacgtaagtgttggcgcgcatgcagcaccacggctacctcgcacgatgtggatggatgctttggagaagaatctggcattatcaagtgaaacacagtgtaggtctgaagacgccagacagaagcacaggtgccacagaattccattcacaccaaaacagggagcgctgactgcagtgagcagccagggcacgtgggctccggagggagcacaaggaattccattcacaccaaaacagggagcgctgactgcagtgaggagccagggcacgtgggctccggagggagcacaaggaattccattcacaccaaaacagggagcgctgactgcagtgaggagccagggcacgtgggctccggagggagcgcgaggaattccattcacaccaaaacagggagcgctgactgcagtgaggagccagggcacgtgggctctggaggtagctccaggaattccattcacaccaaaacagggagggctgactgcagtgaggagccagggcacgtgggctctggagggagcacaaggaattccattcacaccaaaacagggaacgctgactgcagtgaggagccagggcacgtgggctccggagggagcacaaggaattccattcacaccaaaacagggaacgctgactgcagtgaggagccagggcacgtgggctctggagggagcacaaggggctgctgggctggatgacgccgccccaacgtctgcagtagccttgagctgtatatttgctatgagcggacttttgcaggggtcagatttcagtttataaggggacagcaagtaccccactgagacgcggacttaccagtcgtctctgtcgaggtgcggacgctgggctgagactcagcatgaggtgaggacatctttaaaggatccaacacatcttctagatgcttttccagagttttaaacttatgctttagagttcgtatttctgcttcaagggccagaacataatctgccaaaaaaacctccagtgaatataacacatacacagcatcctttcgcacctccctcctgtgagcaccagctcagggagccgatgccagctcatgcccgccagcttcactgtccctgtcctcctcacactacagcttcaccgtagtttccacactctctgtgtgtgtcagactgaaagaccttccctcccctcactggccagagtgtgccagccagagaccagcacagtctccatgctctccaggaagggctcagtgatcaggagcaaatgctccacctgccgccagcccacgtgcctctgtgcagaggggccaagtcccatctcgagaacggaagctctgcctccatcccggcatctgcccacccacagccactcatggggtccctgggggtcgggaggccctcatcagctctgccacagacgctcctctggaggaaaggactgaggtccaccagcccctgctaccaacccattctgggacagcgcgacagcaagccagccctggtccaggtctaaaacaggtttttaagtgtgtcaagcaggtaccctcattttttccttccactttacaaatataaaagctttttggtataaaacttaagatcccttctcttggagaaaaagcagttttcatactttgagtttattacaggggatgttaacttataggactctgaaatgaagcctccttgaagccagtcaagacccatgctcccgtctgtcctcctccctccctctcccccttcctctcccgctctgtccgtttctcccacttactcaccaggagtggcggcatctcccccagcctctgggtcaggctggtttgcatctgtgctctctgccgctgtctggatgggaggaggaatctgatggcttagagcctccatttctttcctcatctgggcaatcgcgtttcgcaagctcgtgttctgctctcggagccgctggatctcactggatggaaagtctttacttatttcttcttcatgctgcctgagaagcatctgtcaaatacaaggaaaaatggctacaaaaagatgaatggttccccagcttgtcctgacaggctgtgcctccgctctccccgcgcccctctcgggccggtcccccgcttcagcttgggctgtggtccctccccatccccaggctgtgatgcccctcctttctgacagaagtgcaaatatgacactcaaattcctggagcctttcatacttttgagatccctagagtgtccaatccacagaggcagaaagtggaatgggggtgctggggctgtgggcggggagggggagccagtgtttcttggggacagagcttcagtatggaaagatgagaatgttctggagagggtggtgtgatggctgcacctccgtgtgaatgcgcttcatgctgctgaactgtgtgcaccaaaaaatagttaaagcagccagttttgcgttatgtatactttagtacaatcaaacatccactaaataggatgaagagcaggttcagagcgcgcagaagaaaaggcagtgaatataaacacctggcaacagaaaatacccaaactgaagctcagaaggaaaggtgccaaagaagaaaaaatgagcagagctctggagaccatgaacaaggtgcacaaggaaccaggagcccagatgaacgcaaagacaggagacgcgtctacaacaaggccagacatgttacaaatgtgctgaaagccacacatcacagatgacgaagcaaatgagctgaaagccgacatcacagatgacgaagctcagtgaaccctaagcaggataaacagaaagaaaatcataccaaacagcacataatcaagctgctgaaaaatcagcaacaaaatggaaactctaaaagcaacccgagaaaagagacatgttaccctagggtcaaagggcaggcatagggatgacagaccccgcaaggagccaccaaggcgggaggacaacgaggtgaggtggctccggtgcaggaggagagacaggccccgcccacccagttcctagggagagggagtgtccttctctaaccaaaggtgaggggcgcttctgcctctgaccaggagggactcactgccatgagtctttccctgcggctgtgaacaactagaacaccagacacattagaggaaacacctgcttccagacgccagcatagaccccagatacgggagagggaaacaaagtcccagggtctggcccaactcaaccttgagtccagccaagatgtgtgcaaaaggcacagcttcctctcctgtggagccaccctgagggacgcagagcctgctccctactctgcactccatgaacacaaacctgaagcaagatctgggcccttcccaggacgctctgactgcccgctggctcctccgtgctccctggcaaggccagctggcctgggctcccaggaggagagcttcacacgctgcgctcaggggtggagaggatgcgaacagaacctgcacctcaactggcagtttagaaacggagacagtgcgatgcctaaccctgtttttactctaactcgctactttaaattttgccctgtttgtctctttaatcacctagccttgtttctcatgtaaataagactctctctagctgggaaagccggacaaactccaactgaccccttaatttacaagacactaagggctccttacccaacccccttccgcaaggagttgacctgtgtaagcagatcctcagcatttcaaaggagcccaattaactgataaggtactggcaccaacaacgtctgaagttcccaggattcttctcaaagagataacaacataaagccttgagttcgtgtccggcatagcatctatgtctaactataatgaaggatttagagccctgcacctggtaccgttgctttttgtaaccatttgtcttttaaattgtttatcgctctgtaaccatttgcttcttttgattcttgcatgtttttacttctgtagaattattgcctttgagttcccctccccttcctaaaccaaggtatacaagttaatcaagccccttcctcagggccgagagaattttgagcgttagccgtctctttggctgccggcttaaataaaggactcaattcgtttcagagtgtggcgtcttctctaactcgcctgggtacaacaacaggaaactgcccaccgcagtgccgtgatcacaatggcgaacaacatgaaggaccattggtaagaaaatcgctaggtgcgttatggtgtggccgcttgataaaacatgcagccatttagattctgttcgtgaagaattgtaatggcgtgggaaaatatttatggtagaaccaaaaggaagaaagaattctcctggagaaacagtcgcatgaggggtagaccctggaaggccgtgctccacctggccagttacagagcgggataccgagtgcccagaggcttaccaggctatgtcccaggacgcgctgagggtgctggctgcctggcctcactggctgagcaggcccaccacagcggcaagcaaggctcagagggctcggcagtgtgaaaggaaaatatcactaagctaaagggagaagtcaagctgggaactgctcagggcaaacctgcctcccattctattcaaagtcaccctttgctcactgagatgaatgcgtatctcactgcctcctttggagaggctcatcagaaattcaaaagaatgcaaccatctgtctcttacctacctatgacccggaagcctcctccccacttggagttgtcccgcctctgcagatggaaccactgttcatcttacatatgttgattgatgtctcctgtctccctacaatgtgtaaaaccgaggtgtgctctgaccacctcggaacacgtcgtcaggacctcctgaggctgtgtcaccggtgcgcatcctcaaccttggcaaaataaaccttctaaattaactgagacctgtctgagattttctgggttcacattttggtaaccacagggagattctgagtggagatgcctctgacctttgacaaaactcctatcggtacttggtactggaatgagctaactttatggctcaaaccaacaggacaatttgccgaggtctgggagcatcccctccagagaatccctgatctccccaaatttggtcaagatctaaagtttattttgctgtacaatgttggcagaagagctgaggcggggcttgcttgtctgacataatgtaaaagagtcttggaacatgtcctgggtccagagtctaaaacccctcatgacctttggaacaccaagctctgtgccaatgggtggaaggctgccctgccgcactacagtctaagcccagggcataaaacccctcgtggcttggagagaacccagggcccagggcataaaacccctggtggcttggagagaacccagggctcagggcataaaacccctcgtggcttggaaagaacccagggctcagggcataaaaccccttctagcctctggaattgtgtccagacttgctggccccttgctccttgctctcccaagatcataaattgattttatcttgaattagaagaacctgttctcccttacctcaagtagcggagcatatgcgaaaccgtcacagctacgcttgatgcaccgctacctttctacccctacgtcctcacgccctcacctgtctacccccacagccacacgtcctcactacctgcttctttacttgattaccaataaacagtgtgggctcccagagctgggggcctttgcagcctccatacaccagcgtgggccccctggacccaccctatgtactcttgtctcattcctttgactctgctggacttcgtagcccccatgacctggtgttgggtctgatcaccccaacggtacaactccctttttttggagttttacttgcttccaacaaggaaggcaagtttctcctgcttcatgatgatggaaggcaggtaactcctttatggagtttgcactcacttccaacagggaagatgagggttttttttttttttcctgcttctaggatggtagagagcagtctttagcctgagacctatccctaggtaagtaactgaattggcatttgccttggctaaagttaagattagcaaccaggccgggcatggtggctcacgcctgtaatcccagcactttgggaggccgaggtgggcagatcacctgaggtcgggagttcaagaccagcctgaccaacatggagaaaccccatctctactaaaaatacaaaattagccgggcgtggtggctcatgcctgtaatctgagcgctttgggaggcttaggcaggcgaatcacctgggtcaggagttcgagatcagcctaacatgcagaaaccctgtctctactaaaaatacaaaaaattagccaggcatggtggcacatgcctgtaatcccagctactcaggaggctgaggcaggagaatcacttgaacctgggaggcggagggtgcggtgagcagagatcacaccactgcactccagcctgggtgacacgagcaaaactctgtctaaaaaaaacaactccaaaaattagccaggcgtggtgatgcgcacctgtggtcccagctactggagcagctgagacgggaggattgcttcagcctaggggtaggaggagattgcagtgagctgagattgcaccattgcacttcagcctgggcaacaaagcgagaccgagaccgtgtctcaaaataaataagtaaaaactacatgaatgaaggacgagctaggaacattcttcataccacttaggatctgagtcctaagtacactcggctgccttaagccaagcctcaaggcagagaagcaaattgaatgggagagaatgcgcaccagtggctggccgcttagtgcggggaggtgggaccagcaggggcagggactcttgggtggtcttgttggggtgggggtgcttgggcacacttacatgtcggctgcactgacctgtgcactccaggcctgcgcgttctactgtgtgtacaatagcccacagaaaaaagccaactgcaggcctagggcagtcctcccgtgctgggccctctgtgctctcccccagcctcctacagccctgcaccccgcttccctctgcctgtggacccagctctgctctgatgagctgtgacagctcagacaagctcctcagtgtccccatgtctcagcggacatggtgccaacctccaagatgaaatgagtggagggatttcaaggcctaagggcaaaccctggcattggatgagtacttaactatcggccactaacgtcactgctcaacaaaatcaggagcggtgatgacagattcctagcataaaatgacctgctgtgacagtcctgaggcaatatcataagaacaaactcacatgaacgtctgatatctagttatatgtggatttgggacttttaaaactttcgaatatgaaagatacaaagaagcctgagttcaccttaactctctaaagcttctgactcacccttgtttgtgcaacaggtcatttaaaaagaacacaactgaaagacttagctccagtcttggtaggatttggggatctggtcctattttcccaccgctgctgttgagcaaagtttcaaagagccgactgggtactctcacctgtgcccctggtctggggagcccatgcatcctcagggcctgcacggcctggtctcgttccagggtcacggccttcagcaccacctcctgctcctgtagcgcctgctctgtctcctgcagcttggcagcaacctgggaaaaacgctgggactcagtccctgtgtggatgaccgggcagctcccatgcctgctgaggctccaatggcacacataggtgggagatgctcagagcaccaggctccccactgtggccaggccgccaaacccttcctgcccatgcataccccaggctgcccttgcaggccagcggggatcatgcagcgctactcaaaccacgcggctggtcaactacagaaacagcttatgcaagaaagtcaaggcgggtggacaggcggggtgcatttttattactctaatttattactctaattactcagtgaggtttagtgttttcaaatttaaagaaccatttggtaagaaccagacccgtcctgcccagccccacctctgcagagacgccgagaaggccccaggccctggtggccgcacacacctgactttttgccatgctcagaccctgaatcagggcctctgacttttggatctggtccctttcaatgtcatcacagcggcgctgccagtccaggcccagctgcacctgatcacgctccaggctccgctccctttccactgccagggacagctgttgcttgtacctaaggacacgtccaaccgctcagcattaatgcttcctgaggtcccttccacaggaaaagcagaggcacgatgggaaaggcagggctgccgctgtccctcctgctctcgcatggcctgcgctgggctgacatgctcccgagctcctgtggatgggcacactgggacgcccaatacaaagacgagcaggcgccaaggatgcccagatgccggagaaaacccaacaccatggatgagggtgatgcccacaaaaccagaagagccagcatgcagggagagggaggaaagcaacaaccttaaaagatcataaacgcggttatgcacaaaggaacggagctatgaaagcaaacaagcagaccagggtggacccagccacggggtgggcagggctgggagagcccccagagcaagtgcagagcagggtggacccagccacggggcgggcggggatgggagagccccccgagcgagtgcaaagggacagaggggtgggaacgcaggaacccgggggcttcctccagaaaaccagcgcacagatgagaatggaaggaggaaaccaccaaggatgtaaaggggcaggtccaccaggacagagcaaacgccagccttcagagagctctagagatcccacacgcacacagtaaggggaaacgttatagtatgaaggacgaaagaagagtctacaaggaaaaaagaacaagaattggactaggactaggctttacaccagcaactctgggacagaaggccatggggccacacactgggggcagaattccaggctgtgggtgatcctgtgacgggggagaggtccctcctgtcccaggcagcgacacagagatggtggcatggctctgcgtgagactggagggagactctcctgctggcctcattgcaccggtaaacttcagggagttcgaatgatagcaattgagccaccgtgttgtgagagggtccctggaggggctgcgtggccaggactgaggacgccgctagggtgcagagtgaccctggctgtcagacagtgagggaatggaggccttggccccacagctggagggactgaattctgccaacagctgggtgagtctggaagggaccctgggcctccaaggagaggcaggcctggccatcattgattccagcctggagagaccctgagccgggaatggctgagccctgcccaggccctggccccagaacctgagataataaatgggtgtttaaagcagctaagctgctaagtttgtggtaatttatacacaatgtgttcttgttttgtttaattatttttaggttttttttggatacagagtcttgctctgtcacccaggctggagtgcagtggcgtgatgttggcttagtacagcctccacctcctgggctcaagtggtcctcctgcctcagcctcttgagtagctgggactacaggtgcataccaccacgcctagctaattttttgtatttttagtagagacggggtttcaccgtgttagccaggatcgtctcgatctcctgacctcgtgatccgcccgcctcggcctcccaaagtgctgggattacaggcgtgagccactgggcccagccccacagatacatttttaaatccctgtaactgcaaaaataaataaatctttaacacaacacagcagctgtcaccatgcctatcttcccactttaaacaactgggacactgggcagtaaatggggcacggctttcacagagcgaacgatgaacacacgagcggtgcggggctgaggcccctcagagaaggtcctcgcgagatgggcccactcgccgcccggcttctctccacaggccattccggatccccgcagggacggcaaaccacgcagagcacggtggtcttgctgtgacgaggagatgaaggttggagtttggagaagctgaagtggctgaaatgggctttatgaggcagaggggcagagaggaggggaacctgggatctgtgcagggatcccctagaagctgtggctgacagccacatgcaaatacacaggagaagccaacaccggctgggccaagagcaactcgtgggaacgaagcagccagcacggggctccacgtgcgctgattcccagagctcgtcagggcggccggcggagcatccttggagctctcgctccagggcacgcagtggggtctgggagtcatagtgctgagtcagccctggtgaaaaggcttctctagacctgccccacctgccctcgcactgattttaaacaagtctcaaatgggtcaagctgccatgtaaatacttaactgcagccaaacaaaaaacagcacagccaaaaccagatgctcgccaacatcatattcaccatgtctgacatccagtgaaaacttaccagatgggcaaggaagtagaaaaaaatgtagctctctccagtagaaaaatcagcccatagaaacagactcagaaataaagatatgatggaattagcagataaatacatttaagcagctattacaaataagttcagagatttaaaggcaaccgtgcacataatgaggagagaaattaaatgtataaaaaagtctaaatattgtaatatgtgctgttttctttcagtgaatggaagagtttaacgaagaaggaacattggaatcaagagttgagaacataagccaggcggggtggctcacgcctgtcatcccagcactttgggaggccaaggcaggtggatcacctgaagtcaggagttcaagaccagcctggccaacatggtgaaaccctgtctctactaaaaatacaaaaattagccaggcgtggtggcgcatgcctgtaatcccagctactctagaggctgacacaggagaactgcttgtacccaggaggtggaggttgtagtgagctgagattgcgccactgcactccagcctgggtgacagagtgagactccatctcaaaaaaaaaagaaaaaaagttgagaacattatcacagcatgttttttttcttctgcattagttcatattatgagggttttctacatacacaagtaataggtaaatctaaatgtgctttcttgaagatacatgatgttttatttcagtcaatggaagtatttaacaaaaaaaaaaaagaatgctggaaggaagagctaagaacgttattacaacatgtttctttcagcattggtacttttcctttttttttttttgagacccagtctcgctctgttgcccaggctgaagtgcagtagcaccatctcggctcactgcagcctccgcctcctgggttcaagtgattctcctgcctcagccccccgagtagctgggattacaggcgtgtgacaccacaccgggataatttttgtatttttagtagagatggggttttaccatgttgtccaggctggtctcaaactcctgacctcaggtgatctgccagccttggcctcccaaagtgctgggattatagatgtgagccaccgcgcccggcccaccaaacatttatttatattttattttttatttgtttattcatttttttgagacagaatctcactctgctgcccaggctggaatgcagtggcacgatctgggctcaccaaaacctccgcctcctgggttcaagtgattctcccacctcagcctctggagtatctgggactacaggcgtgagccaccatgcctggctaatttttgtatttttagtagagacggggttttaccatgttggccaggctggtctcgaactcctgacctcaagtgatctgacagccttggcctcccaaagtgctgggatgacaggcgtgagccatcacacccggcccaccaaacacttttaaaccatcagaactcacttactatcataagcacagcatcggggaaaccgcccccatgagccaatcacctcccatcagggtcctcccttgacacatggggattacaatttgagattagatttggggggggacatagagccaaatgatatcatacagcatacacattcatcaaaattcatcaagtgtagagttaaaatggatgagtttagcatatgtattctgtaataaagttgacttgaatgtgtatgggaaatagaatgctatctttgttcaaggaagtgttcgccccaacggataagaaacacatgaggacatgaacaatcagacaagacagacgaggagattctttgtttttgttttcctttttgcagagatggggtctcactatgttaaccaggctggtctccaactcctgggttccagcaatcctcctgcttctgcctccctaagtgctgggattataggtgtgagccaccacgcttggcaagaggagattcttagtgcagaatcaagcaggagcacctttatggctcttattacagactgagaaacaccatcctctggccatgctccctccagcaggcggccccttctgcatgtcttcccacaccacccctgcgtgaccagacattctatctgtcttgttcactgtctttctcccccaagaaaatgtgaggccagggactcaatctgttcagttttgaatccttagtacctacaacagcacctgcccataggagaccctcaatggaaacatctgcctggggacagttacctttcaatgtcctgctgggatcgggccacctgtgccttgagcttcacctcttcttcctgcagcgtctgaatctgaaggtctctggagaccatctccttagatagttgagcaatttgagcatcccaggcagattttacagttgatgcatcttcacgaagtctaaacatagaagggaaactatgtagatgtggttctcactcactaaagttgtctcttacacagcaccccccagcaaatacacatgcgcgcgcgcgcgcgcacacacacacacacacacacacacacacacacacacacacacacacacacagctctcgagctgaaacttcctggcctagatgatgaagatggttccgcacaggaagaattaagcatccgtccacccaactacctccatgcatgcatgcatcccaccaacccagattccagctaagctcctgcagcacaccaggccatgtgccaggttcttggtgggcggaaggtgaggcatgacatgcctcccatgcccacagagcccacagtcatgaggtagcaacacctctgaccaagtcaccctcatgtcctcgccatgcctagcacagcaccccacgtgcagagacattcagcacattttcaagttgcatggtaaaataaggttctacagaacccactaaataaccttaacagcaggatgcctctgggagaattacccaaaatggaataaatttcccaagaaaatgttcgggacaatatctagagctgttaactcaggtagccacagtactaacctaggcaagatgatacctgcccacttgcatgggcgtagccctgtttccctaagagatgggaagacggcccacaagagcaactgtagcatcacacacgacagaccttcagatgctcctgtgctgatgaacttccaactgacagtgagaagcagagggtgagctggctgcccccacagaggccaccccttgtcacgaggggttaaacctagcatgagtggtgcactcaagcctggtattatatagaatggaaaaaaagccaccctgccaacagttttggacacatattttaggacagctgaaaagagacaccatcaaaggcatcaacgtttccagccatctctggcaatgtgggctgacacagaatgtgtgtttggactccttccacgctttgcgtgggtactgaagaaacagactcaccaacggcctctggtgctctgggaagcagctttatccctggaccatgagccacctaattatgagggccagccccactcccagcatcaggatggtgatgtgactctgcctggggcctcctggacagtctcccctgatgcacagtctcaggtgtagatcaatgggcacggctgctgagccctcactgcagggacagaggacaccacggccacgagcgggagtgcactgctcaccacaagagcgtaaatgctttttgtgagaagccaaggtggaaggatcacctgagcccaggaggtcgaggctccagtgagccatgatcgcactgctgctttccagtcttctctttcttctgcgtaatgggatggttaaaataaaaaagaaggctgggcatggtggctcatgcctgtaatgccagcactttgggaggccgaggcaggcagactgcttgaggtcccagagctcgaaaccagcctgggcaacatgactaaaccctgtctctactcaaaatacaaaaattagccgggtgtggtggcacgcacctgtagtcccagctacctgggaggctgaggggggtggatcacctgagcccaggaggtgtaggctgcagtgaaccgagatcacgccactgcactccagcctgggtgacagagtgagaccttgtcacaaaaaaaaaaaggaagaaaaaaatgctttcctgttaatcctacaggttttctctgtagttccaaactccaaaccagcacaaaactgctgaaaaacctattaagaactacaaagctggccaggcacggtggctcatgcctataatcccagcactttgggaggctgagatgggaggatcacttaagtccaggagtttgagaccatcctgggcaacatggggagaccccatctctacttcattttaagaaagaaaaaaaggaactgaaataaatatggctgtcacttatttctatttttttagttaaaaaattatttttttagagacagagtcttgctctgcctcctgagtagctaggactataggtgagcaccaccgtacctgtctaacttttctttgggtagacatagggtcttgtttcgttgcccaggctcaagtgatcctcctgcctcagcctcccaaagtgctgggattagaggtgtgagccactgtgcctagccgaggtcatcatttaatgccagctcatacttgggatcatgggatccgaatgatagctgaactccccagaagtaaaagaggaaagatacaagctttagaatgtagaagtctgtttcttactaccaaaataatactgcatatgtgtagtaataattctcaatgagcaaagagtatttacggacagaaaacgaaaagacattcaagaacaacatttagcttaagactgcaacggggggccaaggttaggcgcacaggagtggtgacgcccagtcacctcggccgcactacatggaaaatggaagcacctgcggcccctctcaccccgtataccgaccacagaggtcgccccgcacaccgaccgcagaggctttaggtgcctcccatgcatggcgtcttcaaccactctgcttgaatctgactgatcaaacaacaacacagcatgctgaatctagagaaactatcctgaataagcccttaacttcctggtactgtgtagttctaagagccatttcccccttaaacagaaatacaatttgtcagagaattctctatcggtggtggctcatgcctataatcccagcactttgggaggtcagtgtgggaggatcacttgggtccaggagttggaaaccagtttaggcaacatggagaaacctcgtttctacaaaaaatacaaaaattagctgagcatggtggtgcacacctgtggttccagctactgcggaggctgaggcgggaggatcacttgagcccatgaggtcaaggctacagcaagccgtgatcgcaccactgcactccagcctagacaacagagtaagaccctgtctcaaaaaaagaaaaagaggccgggggcggtggctcacacctgtaatcccagcactttgggaggccgaggcagggggatcacaaagtcaggagatggagaccatcttggccaatgtggtgaaaccccgtctctactaaaatacaaaaaattagccgggcatagtggtatatgcccgtaatgccagctacttgggaggctgaggcaggagaatcgcttgaacccgggaagtggaggttgcggtgagctaagattgcaccactgcactccagcctcggtaacagagccagactccatctcaaaaaaaaaaaaaaaaaaagtcaagatgaaagaaaagaaaaagaagaaataaaggaggaaaatggttacaatagtaaattttatgttatgtgtattttaccacaatttaaaaattcagagaaaaggaaaaaattctgacacatgttaaaatgtggacaaactttgaggacattatgccaagtgaaataagagagtcccaaatggacaaatactgcatgattccaacttacaggaggtccccagcccggtcgcatccatagaatcagcaagtagaatggaggtggccggggctggtggggctcggggggagctggcaggggtcgggggggcactggcgggggtcggggggcactggtggggctcgggggggagctggcaggggtcgagagtgctgacaggggtcgggggtcactggcagggctcggcgcgggggaagctggcaggggttgcggggggtgctggcgggggtcggggggagccggcggggctcggcgttgggggaactggcgggggttgcggggggagctggcaggagtggggcagggagttggcggggctggggggagctggcaggggttggctggggagctggcgggggtgggggaggcgttggtgtgtaatgggaagatggaaagttctggagatgacagtggtgatggttttacaacaacgtgaatgtgcctaatgccactgccactgatctgtacactaagaaatggctaaaatggctaattttatgttatgcatatcttactataaatagatgaatgcacacacacatagaaactacacaatttcaaaaataaagaaaaggcaaaaaaaaaaaaaaaagagtggttaagaaaagtgactgagagctacagaagccactctgtctgctgcctggccccctttcctgtggtctggcaccagtgggcccaggtcagcacagccacggccgtccctgccctcaccctctgggtggagccaagcacacgctcactggtcaatggcagcgtccttctccttggcggtgtcagcctgtctccactctgccctgcggagctgcgcctcgagggtctcgcagtgggcctgcagctccagaaccctggtctgcagctcctgcagctgctccacgtgggctcccttcaccgccaccagcactgcatccttctccctggccagacggtcgagctcctcatgcctgaaacacagtgagtgtcccatggcgctcacccagcccccaacacccaggccccagaccctctttggaggcgttcattgccctgtctcgtgcacaggtgctgctgtatgtctgcctcaaggcttcgcagcagccacctggccacctgttcctcattcctcgcaggtaaacatggaccaagccacttttcgatgccaggcccctggcctgccctccagagcccacagccccctggagaaggacaccaaaaggaggtgcatagagcacagtttgatccgatcaacctgcgaaaggaggtgcatagagcacggtttgatccgatcaacctgcgaaagcaaaaaaaggtagatgcacactgccttgtatcctggcagccagccaggtctacggagccacaccgcaccccacctattgattttccaattagaggcaaagtcttgctgtgttgcccagcctggccttgaactcaagcaatcctctcacctcagcttcccaagtaattgggcttataggccacaccactttgcctggcaaaaagattttactttaaaaatattatgttagcagccaggcacagtggatcatgcctgtaaccgaagcactttaggaggccgaggcaggtggatagcttgagcccaggagttgaagaccaccagcctgggcaatatggcaaaacaccctctacaaaaaaatacaaaaattagcctttacggtggcgggtgcccatagtcccatttactcgggaggctgaggtgggaggaccaccggagcgtgggaggtcgaggctgcagtgagccgtgatggtgccactgcactccagcctgagtgacacagtgagaccctgtctcaaaaacaaaccacattagcaacagtattaaataaataaaaaatttaaaaagatttacgtgttgatttcctaccctctgagcatattaggttctactaagcagagtgctatcaggtatatgtaatgttatgtaagccatctcggtgaagtctttgatctaaccctactgggactgagagagtgaacagctctgctgactgggtttcagaccccttggcaaggccaaccccagctgtctgcttccaccaagttggagaagctcattcaattatgagctgatggatgatttaaaattattcctggctgggcgcagtggctcatccctgtaatcccagcactttaggaggccaaggagggtggatcgcttgaggtcaggagttcgagaccagcctggccaacatggcgaaacccagtctccactaaaaaaaatacaaaaattagccgggcatggtagcacatccctgtgatcccagctactcgggaggctgaggcaggagaattgctcgaacccgggaggcagaggttgcagtgacccgagatcgcaccaccagcctgatcaacatggagaaactgtctctactaaaaatacaaaaattagccgggcatggtggcatgcgcctgtaatcccagctactggggaggccgaggcaggagaatcacttgaacccaggaggcggaggttgcagtgagccgagattgcgccactgcactccagcctgggtgataagagtgaaactctgtctcaaattaaaaaaaaaaaaatgatgagacactagtcatctccgtgtgagcagtttgtctctccagtaaattgcatatcccagtatagagtgacctctcaaggttcttcatatcccagcatagagtgacttctcaaggttcttcatatcccagcatagagtgacttctcaaggttcttcatatcccagcatagagtgacttctcaaggttcttcatatcccagcatagagtgacttctcaaggttcttccctatttctcattgtgtttagtgtaatactgtaaaccttcaataacaccatgggacctatgcaaaggtccaccagtgatgctggaagtgagcagaggaaagtcatgcatttgcaagacaggtctgcagctgctggccattctaaaacacattaatccagtctgggtgtggtgctcacccctgtaatcgcagcactttgggaggccgaggtgcgcggaccacttgaggacaagagtttgagaccagcctggccagcatggcaaactccatctctgctaaaaatacaaaaattagccaggtgtagtggtgcatgcctgtactcccagctacttgggaggctgaggcatgagaatagcttgaactcaagaggcagaggttgcagcgagctgagattgcaccactgcaccatctgcctgggcaacagagcgagactctgtctcaaaaaaaaaaaaaaaaaaaaaaaatcttttgataatggacaatgcctcttgccacccagaacccatgagttcaacagcaaggtgttgacgtcgtctgcttgctcccagacataatgcctctaattcaacctttatgagaggccatatggaccttaaggctcactacacatggcgctctttggaaaggatgtcaatgctgtggccgaaaaccccccagaaagaagaacatcctgaaagcctggcaggcttccaccactgaagccattgttgctatagaaaaagccacggaagccatccagcccaaataataaattcctgatgaagaaagctgtgtctagatgtcgtgcctgacttcacaggatgtccaatggtgccaatcaagtaaatcatgagttgtaatacggcaaaaaaataaaaataaaaaataaaaaataaaaaaaaaggtcagggtgcggggtgaaggatttcacagcatggatcttggagaaaccccagagctgaccccacagcagaggaatgaacgggagacaactcaatggggatgagtgcttccgaaccggcgccagatgatgaggaaacagatgtagaagaagcagtgccagaaaagaaactggcatcagacagacactcctgcagaagggctcccatcactcacgcctgccttgactttttaccacgtggaactgtctatgacgtgggcactgagactcaagtgttaaagcgggattggcaccatatagaaacatttttagaggaaggaaaaagtaaaaaagtcaaatggaattacaatgtatttctgtcaagttacaccaagggtacctgcctctcctgccctcccttccacctcctccacctctgccactccagagacagcccatcctctgcctcctcctcaacctcctcaatgtgaagatgatgaggatgaagagctataagatgatctgcttccacttaacaaacggtaaacatattttctaagatttttttttaagacagggtctcactttgtcacccagggtagagtgctgtggcaccacctcggctcactacaggctccacatcccagattcaagtgatcctcctgcctctacactccaagtagctgggactacaggcgtgagctgtcacacctggctaattttttgtattttttgtagagaaggggttttgctatgttgcctaggctggtcttgaactccagagctgaagcaatccacctgcctcggcctcccaaagtactaggattataggtgtaggccaccatgcccaacctaattctacttttttatgacttttttttttttttttgaaacagagtctcactctgtcacccaggctggagtgcagtggcgcggtctcggctcagtgaaacctccacctcccaagttcaagtgattcccctgcctcagcctgccaagtagctgggattacaggcgtgcaccaccacgcccggctaattttgtatttttcgtagagacggggtttcaccatgttggtcaggctggtctcaaactcctgacctcaagtgatccccctgactcagcctcccaaagtgctgtgtgattattttaatgacattttctttcctctagctagcattactttaagaatcagcataggatacacacaacatgcccaatgtgtgttaatgaactgtgttatcagtaaggcttctggtcaacagtaggttctaagtagttaagtttttggggagtgaaaagttatatgtgaatttttgacctcatggggctagatgcccctaaccccctcactgtttaagcatcaactgtatttcaatttatgattttgaaaaatgccaggtgtagacttaaaaacacacgaagagaaacagtgtttgtccagcttcatcatggccacacggtgcagctaagcaagcagtcctgcaccactgccatctgcactgtgtctgtttgggctcgactgcctcggtttcctcatctaggtagagaacccggatgggtgccctcacaatgcgagccagctgagggcacaaccctctctcgctgccaccagtagggtctgcagagcaggctggaaagcagcttcccactgcagatctgattagaaacagcacagacagtgtccttgaagttcttctggatttatacaactgcacaaatatcatgtcaataaaaaatgcaagaaaaatcgcctgagtcactgtccatcgccgttgtattacacagtgtctttttgtatttttagtagagatggggtttcactgttggtcagggtggtctcgaattcctgacctcaagtgatccacccacctcggcctcccaacattctgggattacaggcctgagccaccgcgcccagccaggtgttaaaaattttgtgttttgttttgttttgtttttgagacagggtctcattctatggcccaggctggagtacagtggcacaatcatggctcactgcagcctcaatctcccaggctcacatgatcttcctactgcacctagtccaagttctacgttttacagcactaagaagtctaaacatcaccgagaaagtccagagcataaacagaaatccaaagcaaggctgggtgtggcggctcatgcctataatcgcagcactttgggaggccaaggaggtgggcgggtcatttgaggctaagagttcaagaccagcctggccaacatggtgagaccctgtctctactaaaaatacaaaaattagccaggcatggttgtgcacgcctatagcaccagctatttgggaggctgagacacgagaattgtttgaacccgggaggggaggatgcagtgagccaagatcacaccacggcaatccagcctgggcacagagcaagaccctgtcaaaaaaaaaaaagcaagcaagaaagcaagaaagcaagcaagcaagaaagaaaggaagaaaaagaaggagaaagaaatccaaaacagcgggctcccaggtccgatccctggagtgggaccctctgctccctgggccatcagcacaatggttccacttccctcctctcctggggccactgacatgctgcatgatgttgggagccgaaacactcacttcctcttaaatgtttcctcttccttcttcctggttagctgcacagagtgaagtttatcctctaaatcctttaccctgaaaagaaacaaatatttatggaaggagcaagtgagatgaaagcaaagaccagcctggaatgagcagaaaaggtagaatcccccagactccagtcctggcctgcgaggctgccacagagcacgcctcgggagatgaaggactcgcgcaccgggcgcggctcatggcctccaggtcctggagctccccggctcggctctggagcttcctctccagctcggcgttggtggcctctgccctctgcagactctctgcagcctttgccccggcttccttcagagcctccagctctttgtgcagtagtttaacctttgaatgataaaaatgagttcaaaatgaggtgataattagaagacactgaggcattaggggtacatactgctgttttatcaggattgggagggagaagaaaaatgaaaattcaagaagcagtaaaacagtgagaatgtcctaacacaactcaaacgagactcaatgacttttttttttttctttttggagacagagtcttgctctgttgcccaggctggagtgcaatggcgtgatctcggctcactgcaacctccccctcctgggttcaagcaattctcctgccttagcctcacgagtagctgggattacaggcacccaccaccacacccagctaatttttgtatttttagtagagacagggtttcccatgttggccaggctggtctcaaactcctgacctcaggtgatccacccgcctcagcctcccaatgtgctgggattacaggtgtgagccaccgtgcccggccttcattgaccccctgacagcactcagtaccccaccaaaatcagtctattagggtgccccatacatgtccaagcccaacagaccaatttaactgcacttcatttcttagcacataatttgaaagttatttaaataaggaaattaaacacaaagccaggggtctaggaaggggctcagtgctgagcaagccactcgcgtcccagctgcacactgagctcttcggtaccttcctgggcctgtttcccagcctgtaagccacgggtggtgacgatggctgctgcacccaagcctgctgacatgaggaccgggctgcgcccggcatgggcaggcgtcgagactcagctcttgcttttcctactgatctgtgcaccgtgatgcccaccacgggcaggtgtccagggctgtgaccaaatcacacagcagatgcaggcggaggtgaactggcacccggtgcccacctttgacgggagtgcccaccctgccatggggcacagggcatccacatggcccacctgctcgctgggcttgaactcctgggcccaagggatcctcttgccttggtctcccaaagtgctgagatgacaggtgtgagccaccacacctgaccaaggaaaaaccgaaaaaccttcacgacccaagggtgcccccagttaccttaagctcccgggacaaggctgtgttgctcatgttgtcagcctgcagacggaattcgtgctccctcttccgcattttcgattcaaactccagcagcagttcctggaacaaacaggtttcatgatgaaagaacagtgggaacccagcaaagacccccacccacgtcctgggaggtgggatccagaggtgagcaggacacagtgtttaacagagaaggaccacacacactgtccaggagagaagctggggtcagcgacactggtaacagcactctgggaggccgaggcgggaggatcgcttgagcccaggaattcaagaccagcctgggcaacacagtgaggccctgtcgctacagaaaaaaaaaagaaaagaaaaagaaaaatccttatctccattgagtcaattctacctctgacaataacaaacaccaagatcttccaaaacaagacaagaaatcagagcaaaggaaaccatgaaactgacaagcacgtaagaccctagcttagtaactaaaaggctgagatgccggcagtagaacagagcttcccgacagccagtgccagcatcccagagcccacacaggatcggactacccagaaccacaccggatgtgtgctgcccaagtttcccctagtaaccaaagctgccacgttaaaacgtcacgtttccttctttccagagacaaggatactatctgaacatgataaaaaatccatgttcccaacgtctgagatggctctccctgaacgagccctgctgagtctgagaaattcggcgtggacagcctgggaagtcagccatagtcacggcccagccagaaactctgacaagaatggctgcgccctgccaactacaaccagcctcaaatcgccactgtccccagatgctgccaagagccccccacctgctgggcaggaccacccacagctggatcctcctcaaactccttctttggaagtgactttggagccacttgaggaagcctcactacttagaaaagtcaccactggtctcttactgaccacggattttagacgctggcttcatgcctaaagaactccggctgttctcaaactcatccataatcgacaaagctctttggtttctgagaattccaagagaaagtcctctgcaggccatttcagaagcagcctcagggacctgtgaacaacgggagtgagctcagcacttccggggacaactggacagtccacaggagggcccatcatgacgtgagcgtggcctccttctctgctgacctgactgtggcaaattagtgacacactggcctatcctactatgaccaagctcccaacatccgacaggaccagagaggggaccctgtcacacctgcacaaagcccttcatcactgctgcacctgcacagacgcagccccttatgacacccccatagacacagcttctagtaacacttacacctacctgcatagacagagccatttattacacctgcacctgcagagacgcagcccctcatcacacctgcaccttcacagaagaagcccctcaggacacctgcagagacgcagcccctcatgactcctgcacctgcagagacgcagcccctcgtgactcctgcagagacgcagcccctcatgactcctgcacctgcagagacgcagcccctcgtgactcctgcacctgcagagacgcagcccctcgtgactcctgcacctgcagagacgcagcccctcgtgactcctgcagagactcagcccctcgtgactcctgcagacgcagcccctcatgactcctgcagagatgcagcccctcgtgactcctgcagagacgcagcccctcgtgactcctgcacctgcagacacacagcccctcatgactcctgcacctgcagagacacagcccctcgtgactcctgcagacgcagcccctcgtgactcctgcagagacgcagcccctcatgacacctgcagagacgcagcccctcgtgacacctgcacctgcagagacgcagcccctcatgacacctgcacctgcacaggcacagcccctcatcacacgtaaacctgcagagatgcagccccttgtcacatatgcacacagtggcagcatctctgactgtggtctctagatataaatctataggatgtctttcaacaaaaccccagcacagctgagtctcttggaggtgtaggctgagtttccagaacattgaggagaaattcggtgactgccacttttcagttgaagcatctgtttttaaacttatcataattgaattccaaattcttttccatagtaaataattcatgtttttaaaattatacctttctaaaaataaatttaaaagtttcatcatttctgaggtgtgctggttaattccatgtgtcaaatgactgggctacgggctgcccggatagctggtaaaaaattatttctgggagtgtctgcaagggtgtttccagaagagactagccctcctcctgtggatgggcgtcattcaatccactgagggcctgaatagaacgaaatgcaaggaagggtgaactcgctctctctgcttgagctgagacactcgccttctcctgcccttggacattgggctcctgcatcttgggccttcagagctggaccaggactcacatcagtggctccctggtgctcaggcctttgcccctgggctgaattacaccaccagcttcccaggttttccagcttgcagatgacaaactgtgggacttcatggcctccgtaactgcacgagtgaattcctacaatttatctcctatatatctacacgtctcctattgcctgtttccctggagaaccctgactaatccatgaggaaagaaaacaaggaaacactgtggaggtggctgcatgtagacatcccatcctgtttccctgcagaccatcccagagtggcatctgccccaaagaccccattttactcccaaggagaatgcaggcaatgaaccaaatggttgtcttttcctcagccctatatgatttcagtttcacagtgggcaggcagggaaagcacccaggaaggggccgacccagaggctctacctgtctctgcagagcaagctcaccgtcgagctcctcaagttttctctccagtgtccattttagattttcatactgttcccggtggtggtcaatctcaccattcttgtcactatggtaataaaacagcattaagaaaagccataccaaatattcagcaaaggtaatacattttcaaggtgcacttgacatgtgaaagttggtgctttgcttttatgaaggggtggcttcagcaggacccacggggtagcagaacttccagccccacctggaccagcatgctacacccatctataaaagaggaaattaaatagggcccagagtctcacaacataaaacccaaaatgtccaggatacaattaaaaaaaaaacctgacaaccaaaaaccggaaagatctgaccaggcccagtggctcacgcctgtaatcccagcactttgggaggccgaggtgggcggatcacaaggtcaggagatcgagagcatcctggctaacacggtgaaaccccgtctctacaaaaaaatacaaaaaaaattagccgggcgtggtggcgggcgcctgtagtcccagctactcgggaggctgaggcaggagaatggcgtgaacccgggaggtggagcttgcagtgagctgagatcgtgccactgcactccagcctgggcgacagagcgagactccatctcaaaaaaaaaaaaaaaaagaaaaaggaaaaaaaagaaagatctgagcttgaaggagaaaagataataggtagatgccaacaccaagatgacacagacgctggaattcttcaacaaggaagctacagcagtcattataaaagcgcttcaagtaatctagtaaagcaaatggaaaaacaaatctcagcaaagaaaaagctatagcaggctgggtgtggtggctcacgcctgtaattccagcgctttgggaggccaaggcaggtggatcacccggggtcaggagtccaagaccagcctggccaacatggtgaaaccccatctccactaaaaatacaaaaattagccgggcatggtggcacacacctgtagtgacagctcctcgggaggctgaggcaggagaaccccttgaaccccggaggcagaggttgcagtgatccgagatcgcgccactgcactccagcctgggcgacagagcaagactctgtctcaaaaaaaaaaaaagagtgtgagactgaaaaagtacctgaacatggctgaaaacatcccaggtttggagagaagaatgagcaaaagacttgaagagacacttcacaacataacgtaaagcacttttaaaaggatgctgtaaacactctggaaagcagctatgagaaagtcagcacccgcacggcgggcaagtgggcctcagctgtccaagcactgcacgcacctgcacggactcggcgcccagacgaggtgcaggctgagcaccagccttcatgctggggacgggagcttccagacaccctccctccactcagggagaagctgacctccagctcaactctctctttccctggacactgggcaggtggcacacgggtgtctaccacattagcaagcagcactgcgtgggtcaaatgactgctgactggcactttttatccacgccgcgagatgcgatagagagagggaccatcaacactgtgggcttcccagaagacggtggcgctcagggtacatctgctgcagggactgcagacgcgatccctgcgggctgctacaggagatactggctgcacaatactggttggggcttctgagctagaggggcaccacacccaccaatgtgggtctcctctccttgcacctgacctgccgcagaaggtctctctgctggaccggagcacctggtgtggtcctgttggcccgttcacacccatctgagacccttctgagcaaaccggcccaacacacacaacagagggtagctggtcagttaaaagggcgtggcagaacccagcgcactgacacgaaggacagacaccacaaatcgatcaggaagtgctggacgcacatttcggagcagtgtgcgcaggtggctctatatggggcctggagatgacacaacagattgcccgtggcggctttcacttcgccattccaccacagtatcttctctgagaaatgactttctatgataagaatagtttactcctgcggctttaaaaagtgctttaaaaagctgcttatggccaggcgcggtagctcacgtctataatcccagcacttcaggaagccaaggccagtggatcacctgaggtcaggagttcaagaccagcctgggcaacatggcaaaaccccgtctctactaaaaatacaaaagaaaaaaaaattagccgggcgtggtggtgggcacctatagtcccagctacgtgggaggctgaggcaggagaatcacttgaacccgggagatggaggttgcagcgagccgagatcacgctactgcgatccagcctggacaacacagctaaaaactctgtctcaaaaaaaaagaaaagaaaaaaaatgctgcttatgttagaagaatacataaaacataaaaaaagtacccaggatcctgttaagtgtaaacagagcatgcagccggctctcctaacgtctgtacacacgcatcacacaggaagggcctctgttaatgtgctatgatgaacctgcggtacttctgaagtgggggatggaagagcttatcagagaagcctgtcctccttccttcctgtctcctcaaactctccacagcatggctgggtgagtggagctgaggggataccaggcatgtggttgagttccaggggccccaccacaggccccacaacaaaggctttaggtttttatgtcgacttgccttaagtcagctcatttagttttgaaattactacagacttccattaaaatcattataaattcaaatatgtattaatatagatttataattaatgaaataaattccaaatattaaaaccaatctccattaatttcagagttatatcagaacccagaaaaagacagtcagggcattcctggatccatccacattaactcaacaaacacatgttcagaggccacgaggcactcggccactcagacagaccagctcccgtggcctggaatcagcagcgggaggaggggcagtgagagtgggcagtgctcgggcagcacagcggagcaggaggcatgtgggggcctctgccaggcactgcacaggagggcgcgtcggtcggtggctcacctgtggacgcgctccagctccaggcgatgctcctggaatgccagctgctgctgctgctgcagctcctccaccttcctggcctctctggctagcgcctgcctcagcttagctgcctctatcttgagctcgctcacctctgcccgcctggcctcttcccactccctggcctgggcgaaggcggcgtcatagcgctccagctcgaggtcccgctcctccagcacctgaaggttgtagacaaagtcctcctgcaggcaccgcagtttcccctgcgcctcctccagctggctccgtgtgtcctgcagagccgcctcctgcagctgggtgcggtgtgcctgcagcgccctccactcctcctccttgcgaagcagcagctcattcagggcgggctctgagcccagtggcagcatggtggccgctgcagtaaagagaaatcaggttcagggtgcaccgtgaggggccctaattttcctaccacagtacctacctcacattccctatcaacagttaccacggccgggcacggtggctcacacctgtaatcccagccctttgggaggccgaggcaggcggatcacctgaggtcaggagttcaagaccagcctggccaacatggcaaaaacctgtctctactaaaaatacaaaaattaggccgggtgcagtggctcacgcctgtaatcccagcactttgggaggcccaggtggatggatcacttgaggtcaggagatcgagaccagcctggctaacatggtgaaaccccgtctctactaaaaatacaaaaaattagcctgctgtggtggcacgtgcctgtagtcccagctactcgggaggctgaggcaggagaatcgcttgaacccaggaggtagaggttgcacaccagcctgggtgacagagcaagactctctctcaaaacaaaataaacaaaaaaaaaaggccaggcatggtggctcactcctgtaatcccagccctttgggaggccaaagtgggtgggtcacctgaggtcaggagtttgagaccggcctggccaacatggtgaaaccccgtctctactaaaaatataaaaattagccatgcatggtggcgcatgcctgtgatctcagctactcgggaggctgaggcaggaggatcacttgaacccaggaagtggaggttgcagtgagcagagatcgcaccattgcactccagcctgggcgacactaagactcttttctccaaaaaattaaaaaaataaattaaaaaaaagaaatccaggggaagtagaggaagggaagatgggaaacatggtttgtccagctataagagctaggttctataaaatagcttcaacgcagcactctgtccatttcacagctgagaaaactaaggctgctaagtggctacgtgaggactgacagcaggtcagtccctcagaaccaatgccccttcccacccaacaccctgctcctggaagattcaccacctgatatggtttcgatatttatccctgcccaaacctttgtggaattgtaatccccaacgggggagctggggcctggtgggaggtgtttggatcatgtgggcggacccctcgtggcttggtgccgtctttgtgacagtgagttctggggagatttggtcatttcaaagtgtgtggtgacaatgagttctagtgagatgtggcatctctccaccactcacactcccctcttgcttcgtgcctgctcctctttcaccttccgccatgagtaaaagtttcctgaggcctccccagaagcgggtgccaacactgtgcttcctgtacagccaggagaaccgtgagccaattaatctttctttataaattacccagcgtcaggtatttctttccagcaatgtgagaatggtctaatataccatccgagagtacattcttttgttcttttatttgttcatcatggactgatattttggtaaaaccataaaaataaagtgctacaaaaaataaaatttaaaaacaaaaatcacaaaaaccaataagctgggcacagtagctctcgcctgcaatcccaacattttctgaggctgaggtgggtgggtcattcaaactcaggagttccacgctgcagtgagtggtctattaaaagataaagtttcttctggctggtcctagctgcccccaaccctttagaggtccaagtatgagctcgatttggacacagaaatcccccacaactcttctctggtgtccacacaggggaactgcatggcctaaaagggccacacccagttgggggacaagcacaaacttccggcctggtgggacatggccggggtgctgctgccagagcaggaaaaagccccagcctgtcttagggtacctctgtatctccgggcacctctgcatctcggggcacagcaatggttgtacaaagtcccaactcccagagggagcgggtacaagggcacagccaggctgagcaccggctgtgacgaagcacaaggaggaggtgggtaaggggctgcaagacccgtgggcccctccagaaagggctggtcagcagggcacacccgctgggggcacgagggctccctgggggtcctgagacggcgcttctctgacgaggctctggagcaaagacggtctcctccatcccacatgcttcctgcgatgcaacccccgcgcccagcaccctaggaccatcacgccacctggaccacctcagcctggctcctccaagctgctgcgtgcccacccattgccggagctaacagggtccctaccgaccatctcagcactctcccacgctcctgttcctcgtctccctcagctcctacaacggccccaccgtccaccccgtgtaatgatccttgacctcttgctgtctcccaccttgtgcccacacctcggccaccacagtgtcttaccacaagagacctcaactggcctctgctgtgcactcccacttttttggctgccaaaggaatcttttcaaaaatgctttaccagggccgggcgcagtggctcatgcctgtaatcccaggactttgggaggccgaggcgggcggatcataaggtcaggagattgagaccatcctggctaacacggtgaaaccccgtctctactaaaaatacaaaaaattagctgggcgtggtggtgggcgcctgtagtcccagctacttgggaggctgaggcaggagaatggcgtgaaccccggaggcgaagcttgcagtgagctgagatcgcaccactgcagtccggcctgggcaacaaagagagactccatctcaagaaaaaaaaaaggcttaaccaggcttcccattccactgaggacatctggaccccaggctcctgcctgtcgctgccacgtgccctcagagcctgggatgtgtggcaggtgccgctctgtctgcaaggttcctcctaaccgcagggcaggctcctcctgccagtgggacctcaacctgaacatcactgcagggaagctttcctaacttccatctcacgttggcacaacgccatcaccccagtgtcgggtgtagtgagtcccactgtctggcacagtcttggcgactgaaacattttgtacacagaggacatgcacacacctgtgcacacacctgtgcacacacagggaaagaattggactatcagcaaatacacattaaatgatggaacaccactgtgatctctgatgactcagaacccttcacacagtgcccgtgagtcatgacaacggttctctgcagagcctgaggtctgcgaggtctacgggcctcttctctgagggactgctgtggcccccgtcctgtaccagctgccctgccactgggcttgcctccttaactcattggtcgcagccacccatgggggttgccgttctgagaatctgatcatgcaatcttatctggcctcaaatgtgcccgcgactcctgaccattttcaaaataaagtccgatctccttggcacagcgtatgaagacagaccgaggacacggcccagcctgcgtggctccagctgctccctgcaggcccagagcagcctttatctgccagttcctgtgcacgtgctactccaggtccccatgcccccatctccccactgggtgaggttccttcccaccaggtctcaggactcagcgggtcaccctgttttcaaaagcttcaggcagccaggacaggcagatggcacgtaccaccccctctatgtgagatgggtgctcccaggcctctgtgctctgcacagaagagcagcctgaaaaatccatacagcaagtgactcggtgcagcacccggtgagagcccagcatctccagcgctttatccatcacactcaggacccataagaagccccacacaccaagggcctgtaagtcagccgggctcggctcgcctttccttctgacctcatcatagaacggcctgctctgtttctgtacaaatcccatctcgggatgatccccaaagccccaaggctgagattaattggctttcaaaagcacggactcagcatctggacgcaatctgcctgtcggccagcaggcgtccccagcaagcacctggtttcaagaaggaccatgaagcttccgggttggggagcggcaggagaagccgccggggagggaaggcctcgctgtgcgttcaccctctttcaggagaaccagtggggctccctgaaccagccagctcccagcaggggctggaacagcatgggtgggcatcccatcactttgattttctcattttaaaaatactgagctgagctaacggtgatgttgtaggtttacctgttgtggtacaatgacacatcatggttttcttgcacagttcctggctcataactctcacacgtcacagtcttttgttgcaatgttgggcgtgtcaggcctcaggaaacagaatccttccaggtctccactctcacctgactttccattgtaggtcataagatcctccccagagctcccaccctctaccctgggggaaggaatgctgacttcaggaagcctccctaaacacccaagaggacagggtgtggagaggttcctggggagtggtgggtggggtgtgggggggtcctccaggaagcctcttcccccatatctccccttacgcatctcctcatctgtatcctctgtaataccctttataataaactgttacacgtatgtgtttccctgggttctgtgagtcaccccagcaaatcaatcgaacccaaagagggggctgtgggaaccccaacttgaagccagtggtcagtcagaagttccggaggccaggactcgcgactggtgtcagaagcgggcagtctttgaaccaccattgcaaaattataactcagacagtgaaagagatctgacctaaccaattccatcgtgcttctaacctccaagctctccttgttcattcctgggtgtaggccgaactaagtttaggaggaacttagtttatagtttgaaacaaagacagtaacagccctttcccgaaacaaaccccctttttgcctggggactagactgcctttgtaggactaacaaattagccaaaagattagaaattatggtttagggccaggtgcagtgactggccccggttgtcccagcactttgggaggctgaggctggatcacttgagcccaggagttcgagaccagccagggccacacggcaaaacgctgcctctaccaaaaatacaaaaattaactggggcgtcgcttgtagtctcagctaccaggcaggctgaggtgggaggatcgcttgagcttacgacgttgaggctgcagtgagctgtgattgcaccactgcactccagcctaggtgacagagtgagaccctgtctcaaaaataaaaaaaaaaaaacaaaaaagaaattatggtttaggagtcatgcagctacaggctacaagattctgaccttccccaaattgttcctggggtaacatcactattgtaaaacctaagatcaatcagtgcttgagatattttgcagaccctgcactccatggatcagctggcacccccggattgataaactggctcatccgatcttgtggcccccacccaggaactgactcggcgcaaaaggacaccttcgactccctacgctttcatctccaactcactggccccctacacactaagttatccttaaaaactctgatccccgaatgcttggggagactgatttgagtcataatagaactccgttctcccgcacagccggctctgtgtgacttactctttctctatcctaattcccgtcttggtgaatcggctctgcctgggcagcaggcggggtggacctgttgggtgtttatgtcttgggtgtttatgtcttggggactgagccctcaccctgtggtctgacctctctccaggcaggcggtgttggaactgaaccgaaggacacccgccgagtctgcggcagaactgactgctcatgtgctggtgaaaacctccctctcccaccacatttgatcacagaagtcttcctctgtgctgatgattcttgtggtatcagagtagaggaaaaacagtttgagttttccagaaatacctgtgaataaaatacacataaaataaaatctactaaaaatacacagagaaggggtttctccatgttggtcaggctggtctggaactcccaaactcaggtgatccacctgcctcggcctcccaaagggccgggcgcaggtgtgagccactgcgcccagcccaaatatatatatttttatgacctccatgtataaatatatttaatacccttaacttattattattattttagacagtcttgttttcttgcccaggctggaatgcagtggcgcgatcttggctcactgcaacctctacctcctgggttcaagctattttcctgcctcagcctcccaagtagctgggattacaggcgcccgccaccatgcccggctaatttttgtacttttagtagagatggggtttcaccatcttggccaggctggtcttgaactcctgacctcgtgattcacccgcctcggcctcccgaagtgctgggattacaggcgtgagccaccgtgcctggcctaatacccttaacttataagacacttcctgggactggaaggcaggtctggggtggctcattcactttgtactcaggacagaggactcaatctcagcatcctgagtagctgggactacaggcaggcaccaccatgcccagttaattttttttttaaatttcttgtagagatggggttccactatattgtccagcctggtcttgaactcctggcctcaaatgatcctctcacctttaaatgtactgaatttagctcttgtggcccctcttggattccagagagtgctgctaagccctctgggaggccaaattcagtaatctactcttttgttttgaaacagagtctcagtctgtcacccaggatggagtgcagtggcacaatcacagctcactgcagcctcgaatgcccatctaaaagctacagctcaagcgatcttcccacgtacttataggtgtgaaccactgcacccagcctctcatctactctttaaataggtccaggggacaaaaattatgtacctgtgaccccgtgttttttttcacttcctccactgactgccgaagagtagccacagccatttctaaaactgaaataagagagatgggcagtaggtctgaattctgtcagtggcacttgctggagaagaggggcaccactaccacgaaggaacatgaagggctgttttctttgaacgtgcatttgccaaaaaaaagtgagtaagtgagaaatagaagttgaagtcgaagtcttgtagttgagtttagactttgcggacttttagaaccacgtatacatgtttcatgtgccaaaaacaaagcacaacaaaaaacaaaaaaacttaaaatcagtaaggactcaaaatgaagtagaaacaggtgaacctaacttgattacaagtgcgtaacttgtaataaactcacaggtttttttggtgtttgttgtttgttgagatgggatctcactctgtcacccgagctgcagtgcagtggcatgattatagctcactgcagcctcaaactcctgagctcagatggtcctcctacctcagcctccagagtagctgggactcagacacacgccaccatggctggctaatttattttgtaattttttatagagatgggtgtctcactttgttggccaggctggtttccaactcctcacctcaagcgattttcccccctcagcttcccaaagtggtgggactacaggcgtgagccactgtacccagccagtttttaatatatacagagacacagatatactgaaatagatttgcatgtgtatagtgtatagaaacacgtttcctactctatccattaagaaagccaagaagaaatggcatcccagtagcaatatgtctatctggtactgggatcttggtttctaaacactaccttctaaactaaaaggaaccagggctccttggagaaatgactgattctgggatatgtcaaggcaagcataagataagcctgaattctgtgatgccagaaagaaagaaaatgctcccagaaggttgggacgtgctataaggacagagaggccaacttgaaggggctcctaacacctcaatctggataatgtgagcaacaaagtacgtgatagcgatgggttagaatccatggaataaaaagatgcactaacaccgagaccgcgcccctgcaagccagcctgggaagagatggttctttcttataggaaaatcccaactaataaatgtaggagtaatggaaacagaaaaatcatttaacaaatagcacattaacagttattttggggaaacactcatgggtgctaaaattagtgacagaagtatggttagaaacaagatcttgctgggcgttgtggctcaggcctgtaatcccagcactttcggaggccaaggcgggcggatcacttggggtcagcagttcgagaccagcctgaccaacatggtgaaaccccgtctctactaaaaatacaaaaaaaaaaaaaatagccgggcatggtggcaggcgctggtaatcccagctgctcaggaggctgaggcaggacaatcacttgaacccgggaggcagaggttgcagtgagccgagatcaagccactgcactccagcttgggcgagagagagagagactcagtctcaaaaaaataaaattaattaaaaaaaaaaaaaggccgggcacggtggctcacacctgtaatcctagcactttgggaggccaaggtggtggatcacctgaggtcagaagtttgagaccagcctggccaacatgacgaaacctcgtctctactaaaaatacacagattagctgggggtggtggtgggcggctgtaatcccagctacttgagaggctgaggcaggagaatcacttcaacccaggaggcagaggttgcagtgggccgagatcgcgccactgaactccagcctgggcggcaaagagagactccgtcttaaaaaaaaaaaaaaaagaaaaaaaaaaaagaaaaagagagaaagaaagaaacatcatcttttacatagtggcaagatatttccccacaaaatatttattatttacaaagggaaggaccctaactttatggacacacttggcagacaccacctcagcccccaggacgtgactagcaccaacagccaggggcatcctgtgtctcgtaagacgctgggaagggcacaatttccctgttgaggttttcttgccaaaaatcagtaatatgaaatcaattatgacaaaacatcagagaaatgcccccgaactggggggcattttataaaatagtggactcatcattggatcctggaccacggtaaagtcatccatgaggtagctgctaagcaagaataaatactggagaccagatcatgggatgataccaacatgaacgccagcgtctacatgttgctgaatgaactgtggttctctaagaggtcagcattctaggggctctgggcaaaaggcacacgggaaatctgtgctccttttgtatcctttttctaagttacagataattttttttttttttgagaccgagtttcgctcttgtctcccagactggagtgcaatggcgcgatcttggctctccgcaacctgcgcctctcggtgtggtaccctactttgttttaacctgactgactctctcttagctgagagggccggacagacaccattttggtttcttcgcttgcagccccttgtccccgtcccttaaggacataactggggcaagctgactccaagcacatccaggaatgcgcttactgataaaatactgataagaaactggagcaagctgtaccagcagctcctgggaacgcgctcggttgatggtacccaaagcccctgcgtttatcactttgtgataatttaagcccctgtacctggaactgtttattttcctgtaactgtttctgtaaccatttatcttttaactttttgcctattctgcttctgtaaaaaaatcgcttcagctagcctcccctcctctatttagaccaaggtatcaaaagaaatctagccccttcttcggggccgagggaatttgcagctctagcagtctgtcagtcgctggcaatacaggactcctgagtagtctcagagtgtggcgttctctctataactccctcagttacaacatcgggttcaagcgattctcctgcttcagcctccggagtagctgggattacaggcgtgcaccaccacgcccaataatttttgtatttttagtagagagggggtttcaccatgttggccaggctggtctcgaactccgggcctcaagcaatctgcccgcctctgcctcccaaagtgctggattacaggcgcgaaccaccgcctccggcctttttttttcctctctttttttttttttttttttaaactcacagacactgtaaggctgcctgggcgcggagccgtccttgccggcggcggaacccggggaattctcccggggctgcggggccctggtcggcagcgcccaccgccccaggtcacccacgggagaccgagggaacgctcccgctccacgcggccgcaacccccgccccgccccgccgcagcctccgcgaggggatccccggtccgggcctggccgagctctgagggtcgacctcgcgctccaggtccccaccaaagcgctgcgtccgacaggacggcagctgctggggttttctacaggaagagtggtcggagcggcgccccccacgcctcccacgcctcccacgccgcccgcccgcacctcaccctaacgcccgccagcagcgctggccagg

SEQ ID NO: 655 - DNA, 86 bp, Homo sapiens
aagcccctggttccaaagccatctctccgcgtgactttgaacttggttgaagccacgtagacagacgcctgttggaaccgcaggct

SEQ ID NO: 656 - DNA, 59820 bp, Homo sapiens
catggatggccgcgactttgcgccgccgccgcatctgctgtcggagcgcgggagcctgggccaccgcagcgccgctgccgccgcgcgtctcgccccggctgggcccgccgcgcagccccccgcacacttccagccgggaaagtacttcccgtcgccgttgcccatggcttcgcacacaggtcagtgctcggccggggcgggcgcgggacgggagcgttcgagagcggaacagggcgcccacccctccgctcccgggagcagagaagctttggtttcatttcccggccccggccgcggtggctgcctgggcgctgagcggggccgcgcgtcccgccagccccccaagctgcgtcgccgcggcttagagaggcccttccctggccaccctcccccgggggtctcggaggggcagccccggagccggctgaaattaaagcctttccgcgcctcgccaccctcccccgccccctcctgcagatctaaattccacggaaacctcttttctgcattctgcattcacctccctaagacgttccggggctgggacaacgaggcgctttctgcggaaacaaaacggctgttgtggcggggggaggggaccagggtacgccgcggcctcgcggattagagtggtgtgtgcgccgggcgagcgttaatagggactgctggtgtaagacgagcaaatcctgtttctatataaagccttaaagtgtcagggcgagaatgggtttgcagggatgcatttgccttaacgagtgcctctggtatcccgctaaagccggacaaagcgtggccagagtgcggcccagcctctcagcctgcggcccggggaggagggcagcgcgggcgcgggctgggggtggcgcggggcggcgctcaggatttcggtgcaggcgagagtgcggcggatttgctccaagaggagagcgaggcggatttgctccaagaggagagcgtggggcgccgtgctgggcctcgcagggacggatcctctcgggcggtcccctctgactccctgcccgagaggatcagtccttggcagagcgggcccaggcctccagggcagccctcttcccggtggctttgatatgagtgtcgagggaggtcagggtaggggcagctaccacgcctgaagccctagaggtcaccaggcggcgcgggtagattcgggggaagcgcgcagggctgcgctagggacccgccgggtcaccctggtacatgggtggcttttgtttacagtttgttctaaacatcagaaatgtttgtcgcttttaaaaacaaaattggcagtaacagttattattggtagcttgatgaactgtgaatactaataaaattatatctgctttaatgggattacaattagtgtgtggattaaaacggatggcagagacggggctagaaaggaaaacgtcggaaaaagggagggcactcaaagaaaaacgtacattttctagaaaaaaacaaacttgaaattgcttaattgctaacgggcttccagcatttgcagcgccaggagattggaatgggggagccgcccagtggaggggtctccccagcacttcccgggttggcccacacccgcttccctccctgcctgggcctttggcgaggctgcccttttctctctgttgcccttccttctttttctccctttcttttttctcctctagatttgtaactggaaagagaaggagaaaaagcacttgcctgagcgatgggtgatttaaaaatatctcttctgctgtccctgtggttatcaagcttgtcttcctgcccctgcatgggagctgctgcccacccggctcaggtgcacggggcgctgaggctggggccgccctggcagaagggacagctcgccagcctccccaccagcccctcttctggctgaaggctggtggcccccactgggggtagggggattgtgtgcaccccacctccactgtaccgtgccctccagcctggcaagtaacagcacgacagagacaggggcccctgacactgaggcttgcatgttggtgcacaggcaggctggggctgtcccctccgggaggcaaggccaaattccccatcaggtcaggtcagcactctccctgaccccatgccccagctcacatcctggccaggtccaggccagctgcattctcccccttctgcccttacttccaggtctaggcagcacccgggtaggtgggcgcctggtcgggtggcctagccctttgtcttgctcattctaagtttggccacgtggttcttggcgtgtaggccccggagggctgtgagaaacggctctgggctctggcctggcctgtgtcctccctgcttcttcttgatcccaggtcctcccagcctccccaagcgcagggtgctctagagggcgctggaggcccctcggggctgcctctttcagggtctgaagggtcatgtgtccccgtccctggaggccccatttcctcccccctgcggaccgaagagaacgcttgtgctcggagatgttcaacccatttgtgatgggcaacttggtcatgcagacatccagctagaagcatctgtagctgaaagaaagccttttgaaattgttaagagccagaatattgtattggtttttaaaatttagctgcatgtatttttttaaaaaaagaattataccccagatcactttgctttggtctgtgtctatatatgatctagtttagagagaaaaaagcataattacgttaaacaatttttttgcgtcttgtgtgcggacttccacatggctggtttggctgccttgcttcccattttcctggatggcttcagtccgcaggccacagctgcagccagcccgcccctccctctgctgactgccccttggaaaggaaaattgacccggattcttcccgcctgtctgggagtagaatccaaccatcggggatggaggccctggcctccatgaggctgcctctttttgctgggctgctcttcctgtgcctgtctggcctggcactgccaccccggctggactgaggctgttcctgctggctgccggggctgcctttccccaaccccacccaacactttcagaatgtcagtctgaggggccctgatgggtggggacatggggctcccaggcttcttccattgtttttctaaaaatgaaagtgctgggagctttagactcgggccgcaggttttatggtaaagtgctgttccagtaaccttgtcaccaaaaggtgcaattaaaatgtttggaatcattatttttagttcagtgttagattttgtctctaatacagatggtccggaggcaaagctgtgaaatctaggggggagaaaagagaaatcaacaagaaccaacccaagatttttcatcagtgctactgcctggagccactggggctggcgcctctgctgggagtgtgtgtgtgatccgaggcagccccggcctggggagaggcccacatagacagccccccgtcctggcttctggctgggcccgctcctgtcctggtctgtacgcctcccctctccaggggccagggctccaccaaggcactatttctcatcttggtttcaataatctgctcagattcccctcccgccccttctcttgtcttctttggggtgtaaattgctgaagcctgggaaaccaggtgctctgagcctggggttattgtgggagaaaggcgaaggctccttctggtgggagaactgcaaactacttctttcctgctgaaaaagtgcttcctaccgccaatctcaaaaaaaaaaaaagaaaaagaaaataccaaaaaacacaaccaaaaaatacccccaacttggcagaggaaaaaaaaagataatttcctagtgtgaaaagaccccatcacaggctcctctccctcatcatgtgatatttttttgtaaagaaaaaaatacattttcttaaatacctcattaactccatgacacgatggagtgtttctgcaacagttagcaacattaagtaggtgtgaaaagagttactttccgaagacgtcacccgtcccgctccataagtgacagagttagacatcaaagttgccgcgagcccaaaggagctacgggaatccgggaatgtggggccgcgtggaccggcggcggtggcccgccacgcccgccccgccgaagccctgtttggaatgtgggtttcccccagtggggctcgtgctgccaccacgtctgattatcccggtacggagccgccgcgctttctgtaggaatatccaggtcacgtgagtaataaggcaaattagtgagccaggcagagaacggcgttgtgcaaatagcacatctcccctggaaaacgcgcgtccccccaaacgttccccggttattcttagaaatcttctctcatctccctgtgagacagggttcaacagcccccacagacaggacaaaatgcataggaggctgttagaataacatggatgaggctaaaaatacccctcagaaacacacataaaaaagccaaatccaacaacagaacgagctaaaaatattccaggctttggcaaagagcacagagttaaataaattatacaagagccattcatgggagcaagttgactttctctcttacgggaacttggttcaagctaataaaaataataatttactagccactgagctttgcatgagtttaaatttaattggtggggcttctggcgtttgtcacttcttggcgattagtggtcttgccctggcctgggccagagtggggaggggatgccgaggctggggctcctggcagcagggtcattgtcccctgagaagcagggcctgggtgcaagggcagattacccaggaggctggaggaggatggagactattgggggttccatccaggaaggcagaaaaagaactggcaaggcacggctattttaatttgataaatgattgtacacctttaagagtgttttaacaatcaggatacactccagcaagttgataggatgttcgctgtcaacttacatatgtcatcagagctggctgtgagcataaataatgtgcgagcgcttgggacagctgcagtctctcctggaggctgaggcgtggcaggtagcacctctgtcccctggcgggcacctttgttctccttctctctgtgtgtctggaggcagggaccggagaacagtcgtggggaatcactgaatgctgctttcatcctgggtggtttggttggggtgcctcctctctgcggactttttaggtctccccacgaaaataagagtccccagaactacttgaccagaaaagccactgtggatatgatctgaagctagaatagtagcatcgtctggtgtgttttgtttttgtttttgttttgtttttgttttttgagacagtctggctctgtctgccaggctggagtgcagtggcacaatcttggctcactgcctcactgcaacctctgcctccctggttcaagccattgtcgtgcctcagtctcccaagtagctgggattacaggcatgtaccaccacgccctaattttttgtatttttagtagagacggggtttcaccatgtttcccatgctggtcttgagctcctgagctcaagcaatctgcccaccttggcctcccaaagtgctaggattacaggtgtgagccaccgtgcccggcctctggtgtcttttgaggcagcagatgtttatatatagccacttcccaggagttttaaacatccaccctggggttggagtaagggtaactccctttactccctcctcttccttggctgtttcttaactcaatctgcctcccccgcccccaatcctggcagggccttctaactcccaaaggactatatttcccagaataccctgatctagctccagggtctgagcccgagactgtccatgtccctgggctgggaattcccaagcacagatagagttcagccagtgccgctgggaataaatactttcctggtggaagaaagccttgctccatcgtgcccccctgcccttccttctggaagaggcttctgggccccccggtctggcttcctccctaccataaatacctgaatataggcccataacaaatgggacctgtcctctgtcctctgccctctggatcctgtgaggcagctactgtgattgtcctggccaacgccccaccggagagtctcccccaaccccctgagctcagtacatggcatatgccctcttttggagtggtcttctcagaggggcctggttgcccatcagctgctgtggaagcgatacagggactcctcctgggtagcagcagggccagcctctgcctagggagtccctcgagaaaataccgcccagcctttggggtgcccccttgccctcctgacaccctcaaacaacagaagctgcctgccttcttaatgggttcatcctgaatgagaggtttccaaaaagaagccctccctcaagacaggcactgccttgttcccctgaggagggaggcaggctcgtcctggcctgtccaggggagggtccgaaacccttggctcctggacagcctccttgaggggagatggcctccccttgtgtcccccacctcgcagacgtgctgtgaatgggcttggactcagagcacgcccctgtctgttgggtaggtgggttacttgctctgcattccccctcccagcccccgctccccgcccacctgggaacggcttccctggggttccccggtccccattaacctctgggacctcatttcccctcaccgaagacacagtgtaacaagcaaaaaaaacatcagagccagcgtgcagtgtctggaaaatcacccgcagcccaggcccttctgcaaaggatggggcctggaagggcctcgggcgtgggaccgcactccgctcgggctccgcccgctgacgtttttatgggataatataccgtttcgctcacgcaggcctatttgtcagtgggctgcccctgtttgttgtaatctataatattactgcctcccgtggccccagagcagctgccgcgggagaatccagggatggtgggcgctaggtgtgcgctgaggggatgtggtggcaggcgctgggggcaggcggcgcccaggtcctggttatgaggtcggcgcggggtttgcagcgagcctcgggtctggtggggaggcgtccagcgcccaagctgggagccagccgggctggcatgctgcagctgtccacacgattaggttcccgatcggatcagccaggaagtgggtttttttcattctgacctgctgtggcgaggaagggagggacaaacaggtgggctgggttcctgccttcccttctctcccctaggatcccccaagaaaaagtccagtgtcttgagatgcggggactctgaggctggccggaagtgctgcccctctccggggtctgtgggagacccactgtcacttgcaactgtgaggaacggcagagcagccccttgccccagctcagtgcagggacatggttttccagtggaaatttccagaaatgggggatgggtgtgcttccaatagggtcctctgagcagcaggctgggctccctgaagcggagggtgacattggggggcagtgccttcttggggtaccccaccaaaaaagagaagccttagccatattaagtaagaaagaaaccagcctgctggcgtcttcaagggaagtcgggtctcagtgcgactccctctctctccggtccttggagcacagttgaagctttgctttcttcccctgagacttctgcaaccaggggcgcctcctgttcttaacacatggcatgggtgagagtgagcagatccagggaagaagagatgggggatgcccagaccggagacccaagagacctgagcccaggatgggggtgccatggtgggtgggagaaggggctgcgctgtggggcaggtcccctctcaggcatgaacagacattgccgcctggcaggggtttcctggctctgtggacgtagagctgtggccccctcttgggtgaggcccactctgcagaccccagtaaggatatcccagcggggtctagccacaggttcactgaccaagctcacagctgctcacactcacagatgtggcaacatacacctgctcctgtgtgctcacaccatgaggcaggtgttcacctgcacacacacactcacactgttcacaactggcccacaaggagtcccactccagtggcccctgggaaagccaggttgcttagtgactggcacgggcacctgtctgccccctacgtcctccccaactgctccatcctccgtctcctggctcctggttcctggccacctgcaggagggagcagagccccagatccacatgaccctctgtggctcagcctcccttcagcgccttccccggcccccttcctcctgctgcccctgtgtggctgtggaccgtgtcctcgggctccagctgaacttggccttgccctttcctgagctcttgctcggcaggaggaggacattcccgtcaagatcaattccagtgcgtggcgaatgcctcggggccaggtctggtcccgggcctgccctgaggctgtctggttgtcctggaagccgctgcctgcatggggcactgcttcctgtcctgtgtggccacctccaccccaggcctctgcgcctggggtcctagaggttcctagatgctcggctaccccaggccccacctgcctcccaccccccaggctcccaccctgcacccccacctctcagctgccctcagtaccgtctctgcccaccgtgccctgcccctcctggggcctacccctgcctggccctttacttgggcagcttctacaatccccagtgcctgcccctgccaccctggagttctgatcccggcgtcacatcctctcagagcccccgtgtgactctgcctaagtggagaggggtccccgactgctccatgcccacctctcctttcctccatgccccacaccagctgagctgttcttggcctgcagcccttcttgtccccttctatgacctcccagccctgaccacccacctgggtctgtcccacagagcctggcagcagcccctgcccagcccccctggctggcttgtttggggccagtgcctttcccctgatatcagccacctttcctgggagactgcaggctcctgagtctgggggtggaaatgtccttctgtcccttcctatccccagagctgggctgagccacactggcctccgtctcctgccccagtgcataagtgcccatccacgctcaggtgacgcgcacaggcacgcgtgtgtgggtgtgaagagctctgcttttcccctaggatttcacccccacaccggaaaagatgaacgattaactctgggaaaactaagttaggaggtggcagtggtgagagacccagccagggtctctggtctctttattaaaaatcaaggtgttccccccacactggaccatggcgtggggccacaggctgcgtgggcacctgcctgggggacatggcagcatcccctggccttcgtgtagcatcttcagttgtcatggcggctcctgaggctgtgtgcgctacaccttaaagggtgtcagagcccaggggattggcagatggcgctgtcctctcctgattagcgccacacgaggtggtgggagacagaagtgggggtggggctcctgtcccccgaaggctggagctgcgccggctgagtggcctggggaaggggggaagtgcgtgtgaatggagggaggcagcccacagctgtgaaggagggttctggagggccaggagcgggctcagggtgggggccagttccttttcacctcgtggccctggctggggctgtgaggcgactccctgattgtccacgcggggtcgcgggggtgcagctaggattgggagcaagagccagtggcttcatctgggtcatagagcactagtgggtgaggagggacacctggggagggctgcctctccccgcccaagggcctgctccccttgccactgaccagagggaaatcgggcccagggagaaggccgggtgtgaatcagctgcctcaccctctgcgacgtctccatccacaggccggccctgcaagcacctccccagcaggctgggctgtgccagcgagggggagaccatggccctgggactcatgtcaccaggcaacagcgctgcctcaggcccttcacattgtgggttttgccttccagtcttcaggcccgggagagcacctggcctcagcgcctgcccgagctgaggggagcgtgtgtaatggggccctgccaagccaccttggctgcagctgccccggcctaaggtggggatcggtggcccctgctcttccctccctgagtctaggcctcctacctctaaaatgggcagttgccctgccctgctggagggttgagtgggactgggggatgcagttgtggccccggtgccctcccaggagcactgtggccgtccgtgtcacctgtgggggtcctaggagcctgcacgagctgccggaggcacatggcctgtgcacgccccttccctggcggagactcagaggcctggggaggaggcggctgtacctgggacccttggtggggcctcccccctgggcagcaggcagcgagactcctgagggcccacctcatgcctcaggcccaggccctctcctctgtgtccatcgagggattctgtggccttgaggccttagtctggccgtagaactaggaaacctgggcccttggctcctgtgccctggcacgggggtccagctgccccacttacccctacctgtgcaggggcttgcatggttttggtgtgaaggtggacgcccaccctccagcatgtcctggggcgttggatgtgactgggatgggcagatgtggacctgctctgaggcaccacgggtcgaggcaccacgggtcctggcaccacgggtcctggcaccacgggcagtgcagacgctctggacccccaggtggggcccaggtgctggggggccttcgtggccttccgggtctactgggctctgggacttcagagagcttcccagtggcagagggggactggcccaggggagacaccagcagatcatgtgggatgggaccacagagctggaagagcaaagatgtccccgtatccccccagtctcggggcgggggtgggggctctctgcctggggttgggggacaatgaagcaggctatgcttccccggagtccaggggtggggatggccgctcatcaaacactctgctcccccagggcgggtctcagacctctctaggtccctcccatgaaaggagggcttcggagccgcacctgggtctttgttgtccatatgtctgtgtgaaggcctggggcccccgtgcgcctcccctcgggcctgaggggtccctctctctggggtcacgctcccttgttctcagtcccgcagccgtcctctgcgtgagtccattcatcacgtgcctgcaggtgcctgtgtcctgtctctgccccaggctgaggccgagggtctgcgccacctgggcatgcccagtggggccccaggaggactcgccacccccagttgagcagctccccttctcggcagctcccaaaccctgaccccagacaggcagcaggagctggacgtgccgtcagcccaggcccctgagagtgaggctggagagacgggaggcaccggtgccctgtgggtgggagcactgctggctccatcctccactgcattcaaattgatcagggagggtggggttgggggggaacagggtccttgaggtcgtcagccagccccacccctgcctgcctgcctgcctgcctgcctgcctgcctgcctgccttccttccttccttccttccttccttccttccttccttccttccttccttccttccttgagaggcctctctacccagcacccacgaagacgggtgagctgctggccacccgaagagggtgtggggtggtcaggtttggggcattccagacctgaggccctccaggcagctccccttccactctgcccagcccaccctgccagggaggcctcagcatagtccttgagctctgggggccccaacccagcctccctgggtctctgggcctttgcctctacccacacctgcacgcctcagcaaggtcgttcccgacaagcccctcaccgccccggcccctgcccctccacaccctggtcactcttccctccagctcagcgcttaccatcgtatccctgcatccgagggtagctttgccacaggaagcatttgcattcagcgagacacacaggcgcacagggactcaagtgtggccacgattagggcaggaccagggccccgtggcctcctggtttctggcttcagctggtgacccccaggaggcctgatggcaggtcccccgtccctggccggtgagctggctgtggagtggcaggaaagagcccagctctgtggtcccccaggatcctccggatctccgtagtgggacagctaccccatccggccagccctgccgtgggccctggtcactccaggccagcaggtcgccttgtgggcagttttcctggaagccagtcccctctctgagagttttcatatccctttgggtgtcctaaaaataaacttttaatttattttaattgaataccaaaattaacttaaattgtaatgcatttttgggctaactcttaaaaagcccttagtgtgtgtaaatacagataaaatcaaagaaaattcaaaaagtgtatgtgaggccatgccatccttctaacaagttgagagtttgatggtaaatacttagcagaaatccaaagtgcctaagtctggagggcctcaggtgggaggcggctgggggtcagagaccccttggggcccgtcggccagggcagggagcagccaccacgcttcagcctgcgttgctgactcgtgcacgaggcaggtctgtctggagtcaccgactctccctcctggcccttcccgtaccttcccgggggctctttccccgtccgcgccccccgccccaccctgtggctctgtctcttccctgcatgagtagctggggctctctcccacatgatctcacaactgggtagcttaaaacagcgaacattgattatttcacagcttctgtgagtcgggaatctgactcagggccaggtgttggctggggcctcggacatatccagacccagctgtggggagtcccctccagaggccaccctccggctgtcgtgggtgtgggagtgttgccggctgctggctggaaggagagagtgagagagcgcaggacggaagctcggtgcgggtgcggcctcaccttgcgggggcagtgggtgggtgtcacttcctccacatcctctttctagaaacgagtccaggtcccgcccacaccaagcgccaattacataaaggtgaacaccagggtccagggttatcagggccttctctgaggccccccacagcagccatacgctccccaaccccagagtgggccgtcgggaccccacccgtggctgtggctgcctcccctgtgctgaccatgccccccccgggcgctcgctgctggctgggggagacctgccctcgggggtttgtgcctttcctctgccccatgccctcggcctccttccctgtgacttggccaagcgtaagccccgggctcactggaagcctcgctccttctcagcctctgcacccccgtgccagcctggtcctggacatctgaggcgaggctggccctgttcgtccctcacccctcttcctcccccttctgtcttccccccacaccacaccaccgcctccactctgggctgtcccctccgcagcagcgggcccctggatacccgtggaccgtccccaccccagccagggcagtgctgtccacgcaggtgcagtatcgtctcagcacctgtgggaggtccgttcccagacgtcctgccttggtggagtgagcagaccccgaagcagccacaaggccgcgggggctgcagcaaggtcccagggcccatgcgggaggcagcccgctcggaccacctgtggcttccctgcactccaggctgggctcagggcgcgggtgcgtgaccctggcctgtcatgggcactcagcaactgttcgtgtaccagccgggttaaggtgtccttctctggatggggcgcagggctcgctatggggtgctggggcggctgtgtcctctggtctgggcagcgctttctccttccgtttctgcatcagctgcctgcctgggtggggtccgcaggtgcgtcagccaccccgggggctcccccagcccaccttgagctgacgctggcagcccacctgggtgcccttgggatggggagctggccctggacctggcctgctggatccatgtggtctgagcgtgtctctagactctcctctgaagctgtgggggtgccttctgagccctgacccgtgccaaggagcccccgcacagcagcccaagccacctgcccaggaccagccgtggccccctcgatgtccgccttggcagcagagcggctcctcccatggcaggacctgtgctggggcaggggcaacggtgtgggggcacctccttcagcgagggccaatgcctggcgccctggcctctggggcaggtcttgtctgggcagcagaggctcaggagggcgctggttctcccagtggtccgtgaggccggcagggcatgcaggcggccagcatcacggcccggaccccacagaggcggagctcgggctgtggggttgggtgctgagggcactaggagctgccggacctcaccagggccttttctccctcggacctcccgtctgggccccaaaccccctcggccagccccatctaccccatcccagaggtccctgcctgagccacccacctcgcccgctcccctgcagagttcctaggaacgccgagtttttacctcagaggctgaggtgaaaagtaagatgaataagatgaacgtgtgtgtcgtgaggacgtgggtccgtgcggcaggagcgctggccgtcgggagggcctggtgtggccgtcgggggcaggagggaccgaggttccccggggttcgtcacagcctcaccacgtgtccccaaccccaaggccccgggacggggtgaggctgggggcggaggcggcaggcaccccctgggcccagccgtgcccactcccctgatcgctgccacgctgcgctgagaagtcctgtgtgttccctggatcccggtgtggtctccgtctcccaccccggcctgtcgcatccccacccgactggccattacccgccacggtgtactatcctcgccagcagctgttacccgccccggcgtactgtcctcgccagcagccgtgcactctgcacgtttgccccctggttcccattggagctctgcccttcccgccccggcccctcttccagggccaccagatgctgcgcggggggctggggacgggcccgggcgagggagctggaggagggcacctggccgtgtgacccccaccctctgagacccgtccgctggcagcttcctggttccttcctctcctccacccatcttcctggaccctgggtttgcccatgcctggctcggtgccacacagcaggggacaggtgtgctcagcctcttggggtcgcagcagggtgctgcctggaggggagttccaagggggaccttcgttgtgaaggagggcaggctgggctttttgaaggtggctgggtgtgaaccacgccttgagacacagagtttggcagggggcatacgtccccctggaagggtaacgcgagcgcgaggccccatgtggttggagccagctgtaccaaaagcagttggctgggaaataacagaaaatggcactttagtgggggccggtccctgccctttcagcctgcagtgacctgtgctggccccagccccttcctgggatactacagcctgagccaacctcgttttgggagtcgggctcttggcacctggtccttcttagcaccaggggcaggagtgacctgagtcccctcggtgggaggtggagctctcccggccaacatagccacctccatgctggatgtggtgatcacagcgtgcgaagctgtccctgctccctgacctaccccccagccctgcttaagctgactgacacagaccatagtttctctcacctgggtgcggggaccccagctctgggggctgcaactacccacagaaccatcgaggacggcccaggatggctgtgggcagagcgccccaccctgccagggagaccatgggcctcacacctccaggcaggccaggctgggaaacaatgtgtgcgtgtgcgtgtgtccatgaggatgggtgtatgcgcgtgtgtgtgtgtccatgaggatgggtgtatgcgcatgtgtgcgtgtgtgtccatgaggatgggtgtatgtgcgtgtgtgcgtgtgtgtccatgaggatgggtgtgtgtgtgtccatgagggtgggtctatgcgtgtgtccatgaggatgggtgtatgtgcgtgtgtgcatgtgtccatgagggtgggtgtatgcgcgtgtgtacgtgtatgtgtgtccatgagggtgggtgtatgcgtgtgtgtacgtgtgtgtgtccatgagggtgggtgtatgtgcatatgtgtgtgtccatgagggtgggtgtatgcgtgtgtgtccatgaggatgggtgtgtgtgtgtccatgagggtgggtctatgcgtgtgtccatgaggatgggtgtatgcgcgtgtgtacgtgtatgtgtgtccatgagggtgggtgtatgtgcgtgtgtgtgtgtccattgagggtgtgtgtgtgtgtgtgtgtccatgaggatgggtgtgtgcatgtgtgcgtgtgtgtccatgaggatgggtgtgtgcgtgtttgtgtgtacatgaggatgggtgtatgtgcgtgtgtgtgtgtccgtgaggatggtgtatgcgcgtatgtacgtgtgtgtgtccatgaggatgggtgtatgcacatgtacatgtccacaaggatgggtgagcacacaggagggtgagagcctgcccccctggccatcccgagcctgcacctgcctccgcccacctttcttcagctgctctggcatggagcctgtgtcattgacgtcgcctgtttgggccaggtggcaggagttaggagcacgctcgcagcctgtggctggtccacttggaggatgggagaggctggccagcagggccacatggctatgtggacacagggccaagagcactagagtctccctacagcccggctctgtcggggctcatcctatggctgctgtgcccagggaggccttgcacccccatccgttgccgtgttgtcccctgcatgtccacagctagactggacatgtccagggtcagggcagggggtgggggctccggttgagaggccggagtgtaggagggcaggtgggtgtccacgtggcctcccttgctctgcagggacccgagggccagggtggattcctgggctggggtgtgcgtgcgtgtgcccctgacatcttcaccggggtgtccgtctccccgcagctggctgtctcaagatggtgggatgggaagcgttcagtttggggcgaggagactcatccagctgcggggggcggcgccgagggagtggcgctgaccaccctggttgcattcccacgcccctggccgaccgccccacagccctccagagtgtcttaggggcaaggggaggtcctggccacccgcctgcccaggagagcgggtgagagacatgggagaaggtgtgaagaattggagaagcagagagggagcctgcctgtgccccaccctcagtccccaccatggctgctctgagtcacttggcacagagctctcaggggagggagaccgaggagggacgccatggggagcgtcggccaccccccccccgccctagccaaagggctaaatttacccttttaataagaaccagacttatatccgattttccttttcttttattagttctgggctgtcggtggctgagcccatcctgtcatcatcacctccgggccgtttccacgctgattgggttgggtacacagcaaccacagagttttcctattaaggcctgagagacgctgcctctgggccagcgcaggcttctggaaggttctcctgagccagccaaggggcttcccgggtgacgtgctcctgttcctgggcgggcgcccctcccacaggctgctgcaggtcccgggctgagcccatggctgcatgctcttggccttccctgcagcccctccctcgctgcccccacactgcttcccatcctttcgcacctcgtttttctctgttactcctttctccctgtgcccgcctcagtctccacttgtccagctgccttcgtggagccacaggtggtggggaggtttggtggccccagggggccaaggcaccctcagacacttccaggctgtgggggcagaagaggcaacagtaagcagggcgggccccgtgtccaccaggtgtggagggagcagtgctggacagacggacatctggtggcagcaggtgtgcagtcgggacagagcgccgccccgaatctggacagtttgcgggccctggagagggcttcagattggagagggttccaggacagcccgagaaacattgggtcctgcttctccaccacagaggggagctgggcctggccacgtgacctgttggctgcccgccagaatctacaagactcccaagggccactttagggtctggggtctcactgccccaggagacgcagctcagaactgagcagctgtgccgggtcagggtctggttcccatgcagcagtgggctggggggctggagctgcaacttgatggagatctgaggcccccctctaccaccagtgggccgggacatgccccgacccagggcagctgttcatcccggtgccgcttcaatgccaccttttgcacagcggaggccaagagcccttgccaaggttcaggtcagtaagtggataagtctggtggaggcctgagccctgggaagcagcatctttgaggacttgcccagctgtgtggctcccatgcccgagaacagagtctgccaaggtgcgcacacccacagacgtgtgtgtgtgtacgtgtgtgtacgtgtgtgtgtacgtgtgtgcgtgtgtgtgtgtacgtgtgtgtgtgtgtgtgtgtgtagccactcatcccagacatgtagcacagtcagaccttgtgtgtacacccatagtcacgtgcatatgcccagagacaggtttgcacagacacaccccgtgagtcacacacagtccctcccctgcctctgtgcaagtgtgagtgtgtgcaagtgtgagtgtgtgcaagtgtgaggtgcaccccacatctcgagtctggaccactagtgattgcagccagggtgggggaagcatcactgggttgtatctgggggttgagcctgcaaacacctgcacacccagcatgcacctgcctgtctcccagccacatctgcacactggggtggcatgtggctgggcctctagcccctgccacagcagcttctggtctcctggtgcgggcggaggtcccagagtggcctctcaccccaggcagagcctggtctccccaccccgtccctcattcctctttctgggcagccaaatggtcagatgctacacccctgcctccaagcaggctgcacctcccctctgcatccacgcaggaacctgtgcagggcggcttcctccccgcgctttcccggaatgaggaatgtggggcagggccagcaggggggctgctcctccttcctgcctcccctcccgtcctgcacagctcccttgggagcctggctcgtgggaagtgtgcttgggaccgcccatcactccgttcccagccactcctggtgtcccccgcctgggcgggccctgtggggagcggggaaggtgtggagcggaagccagtgccgagggaagaggggagcctgagtgggtgtgggtcgggggtgggagctgacgcaggcggcgggtgcagccgccagactcggagccggggaggcccatgccagcagcccggcagctgggcttccggaagcagcgggagccgggagcctgggaagggcctcgctgcttctctggagctgccgccatctcaacgaggcgtttttttttttttttttttttacaacccatttcacagtttccagaaaaggaggatgctgtctcggcggctcacttaactcaaaacaaatgctcgctctgccggctccgcgcccgcctctcccggctcccgggccctgccgtcctcttgttccgtctgccttcagtctggtgccacagggcggagcagggtcagcctggcaggagagtggggtggggcacagtgggcacctggccatccgattgcccaggcccagcctctgctgtgtgggtcctcgggaccctggatgggggctgctggcacggctgctggaccgacccttacagagggagtggctctccggggagtcctgggctccagggccccagcatgctctgtacccctcaggctgcccagcatgtgttgcccttcttagccatccatggcaaggagcctggaagacaggttggcaggaggcaggctagttcccatcggctgtcctggccacttagggccacctctgctgtaagcccatgtggccagctctcacctactgtgtgccggcctccccacacagcacccctgggccggggccaggctcactgggcaccgagactccagcccagctgttgtgcagctgttccccagtcttcccgctgctgggccaccctgggacagcaggtccaggcacagcctgcctcctggtctagttggctggaccttgggctccgggtcagactggcctcccagggatggggctgtgcccgaggacctgagccacctgggggtggccacagccctcctggtgttgctgtctcccgaaaccatttcctcagctagccggccgcccaagccaggcctctacagcatcttgggcagagctgaggtggccctggagctggggccagagcccggtctggatctagagctgcaaacccggcctgggccggctgggcagtgggggcagccaactggaggccagtgtgcagtcctcggtggccccgctgacaccgcatcccgcttactgtcccttccccaggaacatcctaaactcatgctgcctcctgtgatgagagctgatgggaagcctggcagagcggccccaggcaggctctgtgtggggccagggtgccctgaccatgcacgcgggtggggacaggccgtgttcagcccccagcggagcacttggggctatgggcctggaccagcaacttagacttggtcatgctccatctcttaccagccccatggcgggcccacgaccgaccttgggagcatgatggcactacgtcacatgagtctgaagccccaggtaggggaggtgccactgcaggcagtgccaggatggggcacttggtctgaggaggtctaggtcaagaccccctccctggcccccagctgcctccgcctgggctggtaaccacagcacttcctttgccaagaggaaagagccctcagcccggttcccggctggccttggcccacacggtctggccctggctggagcccaggctacactcggctcccaggcagctgaggcacaggctctgtctggggttggccactggtcggcgggggggctggggaggtggcagcctggtctgcccacggctctgctggccagtcacggtgccatccccaaacaccgggaggcgggggtgacagtagaggcgtgatgctctgtcctggggtttcccgggctcctcgggagctgagtgggatagggagggcctcaggtggccggcagtcccgtcccccacactcgcaggggtcaccacagtagtgaccacctggcagggcctgcagaatctgcttccaagtttcaagccaaggccaggacagtgggggagaaatccacgcctttagagtaagcatctgagagcccccagccgtgtgcagggcccctgctcacggggcaagggggatgccgggcagaggctcttcccctgcctggtcccgtctccgaggtgctggcctgctgagcagccagtgagacgccctggcagcagctgccgccagagccaggatttccagaagcaagaggccaccccagtcccttgggggggatggtagggtctctcatggtaggctcagtacgcaggatgcctgggcacggaattggggtgcagcatgcgaccccatgtgatactggagaagggtatttgcagctgtgcccagaagtggtcccagaacgctcatgcgagggcctcagggccggggtctcgggtgactccgcttcctctcgtgatttttttttttcttggaggcggagtcgcactttgtcatccaggcgggagggcagtggaacaatctctgctcactgcaacccctgcctcccagattcaagcaattctcccgcctcagcctcccaaatagctgggattacaggtgcgcaccaccatgcccggataatttctgtatttttagtagagacagggtttcaccttgttggccagggtggtcttgaactcctcacctcaagtgatccaccaccttggcctcccaaagtgctgggattacaggcgtgagccaccgtgtctggtctctcttgtgctttattacctgagcttattatggtgaaaatacaaagacataatgtttgtatgacaaggagacagcaatccaggtggcccgtttccagaatgaaagggaaaaagaagtgaaagagatccccagatcagcagccctgcctgactctgggcacagacagcactttgggacccccagcttggtgaggctggtcaggtgcagggaggggctaggctagagcccccatccccttccctctcattccccagactgtggggccggggacccttcctcagtgggctcagataaggcagcacagcagggtcccccaagtccggagacaggctggttgcccactgagggccccgtgggacaccggggagtgtcctgcccccacctgatgtggtgtgggagagctcaaggtacagggttctcaggccaggatcctggagaaatcccttctccagacccaacttttggacttagttgcttcccaccatcccgaggaggaaaaggcgggagggacttccccaggagggtgtgggggtgggaaggcctgggggactcgaggcgggcctgggcgaggcagcggcaagcttccaactccgaggggagcccacactcaccccacaggcatgccccagtgtccccaagcaggggaagccagcacttcccttcccaacccagagtcccctccctggctgccgggcctgtggtctggccccggcccatggcagtcccagccttgtggtccgggaagcccctggctcgcgggcaccttcaccccctgccctgggcctgggcctggccctgctccacagtcccttgggccggctcttcctctccacccgcccacccgccgcagaggccagctcacagcccacgtcccccaccagcactcacagacccctcctctgctgccatgactgggagaggccccttgagtccacatggctgcgttcgcacacgagaggggaaggggccttgggggccctgggctgggaactggctcagcacagcaggagcctgccagggccgtgcagggcagcccccgccgccccccttgccccaccgcctctgctgagtcacctcatgtctgggaagttcccagggccaagccaggctggatgaggcatcagaaattcacaaattccccctgcctcccgggcaggggaatggctgtcctgactcacctcgggctgggcccccgcagaccccactatccccacgctcagcctcatacccctctttcccgagggggcaggccccccgccccaggttcctggaatggtcccaggccaggcttgctgcccgtgggatggagacgacaaggtgccagggtgcctggctggagtgggggccgctcagtgacagcctcagaccacccacggagcagcagggccaccgtgtgcagaaatctgtgtgtgctgtgtcctccgtgtgcaggagccgatagtcatggcaactctgggaggctccctcgggctggccttggccactggacttgggcagaggtgggcacagctgaggggccacaggcaagcatgcaggcgggccgatggtccgggagagctgggctgggcggggcctggggcgctgggggctcaccatttcccacactcaggctgccaggagaagtgcggggtatcctggcggtgcccaggaaggagcctctcgcggcctccacctgacccagaggtgagcgccatccgcagctctgtgccagcccagtcggggcccagccccaggaatcctgaagggattttagaagcagatccgtcctcagcgccacccttccttcctctgtcccccgccctcagtcttccccctggctcagtttctccctctgctcgcctgagactggggcactcctgtctgacaagtcagtttattgggcctgggtagagggatgaagaccccactcaggagagagaacagctcctcccagtgctgcctggaggggccgagactgtggggcccgtggagctgacacagggcctatggctggggccccgctgaccctggtgcctcatgtatcaccttgacctttttggcaagttcgccagtgtgtgagaggccttggagctgcccacagctgtgggctgggagagtcagggtgctctccctgtgaagaggaggcccatccacagaccctgaaagttgattgggcacagtacccagcacccacctgggtggtagtggtggtgacagtgatggtggtggtggcgagtgatgtggttattgatgatgattggtgattgatgatgatatggttgttgtggttggtgatggtggtggtggtgtggttgttgttgaatgtggttggtaatggtggtggatgatgtggttggtggtaatggtagtggtgatgtggttgggggcatggtggtggaggtgatgtggttggtgatgataatgtggttggtgttgtgtggtggtggtgatggtgatgtagttggggtggtgttgatgtggttggtggtggtgggtgatgtggtttgtggtgatagtgctgggtgatatggttggtgatgatgatgtggttggtgacaggtgatgtggttggtggtgatgatgatggtaggtgatgtggtagtaatgtggttggtggtgatgtggttggtgtgatgtggttggtgctgatagtggtgggtgatgtggttggcatgatgtggttggtgtgatgtggttggtggtgatagtgatgggtgatgtggttggtgatgatgtggttgggggtgatagtggtgggtgatgtggttggtggtgatgtggttggtgggtgatgtggttggtggtgatagtggtgggtgatgtggttgggggtgatagtggtgggtgatgtggttgggggtgatggtgggtgttgtggttggtggtgatagtggtgggtgatgtggttggtgatgatggtgggtgatgtggttggtggtgatgtggttgggggtgatagtggtgatgatgtggttgggggtgatagtggtgggtgtgtagttgggggtgatagtggtgggtgatgtggttgggggtgatagtggtgggtgatgtggttggtggtgatagtggtgggtgatgtggttggtggtgtggttggtggtgatagtggtgggtgatgtggttggtgggtgatgtggttggtggtgatgtggttgggggtgatagtggtgggtgatgtggttggtgtgatgtggttggtgggtgatgtggttgggggtgatagtggtgggtgatgtggttggtgtgatgtggttggtgggtgatgtggttggtggtgatgtggttgggggtgatagtggtgggtgatgtggttgggggtgatagtggtgggtgatgtggttggtggttatgtggttggtggtgatgtggttggtggtgatggtgggtgatgtggttggtggcgatgtggttggtggtgatagtggtgggtgatgtggttggtggtgatgtggttggtgtgatgtggttggtggtgatgtggttggtgatgatgtggttgagggtgatggtgggtcgtggtggtggtgggtaatgtggttggtgatttggtgatgatgtggttggtggtggtggtgggtgatgtggttggtggtgatgtggttggtgggtgatgtcattggtgatgtggttggtgcatgatgtgattggtgatgtggttggtggtgatgtggttggtggtgatagtggtgggtgtggttggtgatgatgtggttgggggtgatggtgggtgatgtggttggtggtgatgtggctcgtggtggtggtggtgggtgatgtggtccccaggcccacccttccccccatccccaggcccaacctccccccccatccccaggcccacccttccccccatccccaggaaggctgcgctcctccctgtggggttggtgcctggatcctgggcaggctgcccactgcgttcattctggaggctcccatgggaacctggcacctgctcccgctcttagctaccttgctcagcctgggaacagatggagctggcccggcccgcccctgaggcagctgtgggtcaccacttgggccagttccctgcaggcctgtggatggggaagaggctgagcttctgaagcctcagggggccccaaggattgggcactccagctccaagaacgaatctcttgctgtgccgccccgcaaccactcatgtcccgggagctgcactttgaaacacagcctggacacccgggggcctgcccacctggggtgaggggccgtgtgtgggagcaggggtgtatggcagagagcagacaggactagggaaggggccgctgcaaggctgtaggcccttccggccctagagtgggagtgggaactgcccatagctgcagtcactgctgaggcccctcctgtgcccagggctggagtcatcagtccaccgaggcccctcctgtgcccagggcaggagtcatcagtccaccgaggtccctgtgtgcccagggcaggtgtcatcagtccaccgaggcccctcctgtgcttagggcaggtgtcatcagtccaccgaggtccccgtgtgctcagggcaggtgtcatcagtccaccaaggcccctcctgtgcccagggcaggagtcatcagtccaccgaggcccctgtgtgccccgggcaggtgtcatcagtccaccgaggcccctcctgtgccccgggcaggtgtcgtcagtccaccgaggtccccgtgtgctcagggcagccatcatccgtcaactacagcactttgtgtgccgcatgcggacagggtttcagaatctgtgtcagcccagcactcggggcctggcggtcatcgggtagacccgtgcactgcacctgaaacccactgacaccctgagtgacgggggtgtcccgtgaagagccagtgctgagttgcgggcgggtggaggccaggctgagcctcgtgcgtgtggctgcacggcagggacgtcctgcgtgacagggacgatgtgcagaacctcaagaggagcagggaccacttgccaggccaggggtctcccgggactcccctggggtcactgtggggggagtaacaggggatctggcagagttggcaggaggtgggggaggggtgtctgcttctgagccaggaggatgggccctcgctggacagtgggtatttgagacagtgcccacagcctcccacgttccccagggcctcccaggctggctgcccacgtgcacattccaggctcggggccacgcccagctgactgcatgacccactgcccgcccagccaggcgcatgtgggagccgaggtggtactgcagtgggagacaggtcgaggctcagccgtgggaggccagcgtggcagaccttcccccagggaggaggcactgccgtttgtcaggatggtggggtgtccgctgtagaaggttttgtcctcaaaggcgtgcgggctggggcagggcgctcgaggtgtgcttcagcacccccagaagtttgctgagcctgcagcatcctggccctgagctctgtggccccaagtggggcttcctgggtgaccctgcagtgggaagtcccctgaccccccaggtgatcttggtccttctgctggctggcgtccctccctcctagacctggccgtgaagataccccaagttcagcatcctgagagacccaggagcagcccctggttttccacggcagggatgctccctggaagggcagcctggggggtgggttgtggccacctccccagatctggcaagaggaggaaggcgcagggctggcctggagagggcagggcctcgacgtgcggggctgttgggaaaatgtgctgtgtcagaacgcaggagggatgagggggatgaggtacctggagtgggggtgcccgtcaggcagccagggctggtgcaccctgggtgggggctcctcctccctccccaggggtgagaagccaccaggcctcccttctccaggtgggcaggaggaaaggaagggtcccctcacccctggccgtccccagcccccatttctctgcacggtgccctcccactcctctgtccttcagccctgccccaggggcacccccgacccccactgactgcccactctctctcctcctgcccacaccacaggcctcctacctgcaacccttgacctccccagacgtggtgagctcaggcctgggggtggttgggaggggtctgggggtgtggccattgtgtcccccgcccagcccacgcgtggccccctggctttactaacccatcaggtgcctgtggctttgagcctctgtctcctgcagtctgtcccatcacaggactgagtttggagtctcctgcccaccgcagtagcaggggcaggatgtggggacctcggtgcgacccccactgcccccagggctcttccccacgctccaccaggctccgagggcaccagcagcctgtgtcctgaccacctctctggcggttcgcttagcccagggcttgcccttgtctgttggggtgatcataaaagctcccgtctcaaaggggtctgggaaggggaggttctggagccccgacgttctagcaggagcttgcagttgaggacctctggctctgggttcatatggccccagaccctgctggctgagccctcttggtctctggccccggaatgtcccctccctgccatctggggcctctactgtccccctggagccctccccaggaccaccacccccactcctcagtggcaaccccttccaggatgcctgtgtgtccccggcccggccgcagcagccctgccttcccccactcctcagtggcagccccttccaggatgcctgtgtgtccccggcccagccacagcagccctgccttctggcttctggcctcagaacagctgctctgattcataaaaatcatttttaaattttctttctcagttttgagagtatggtcttattgggaaaaagaaaggggctttctgtcgctgggctgggaggaccttttcccttcctttctctgccccctgcccaaagatgaccccaccctgccgactgggcctctccggcacccagcccctccctctctgctccccgcccctccatcccatctccccactccctcctccttccctggctccctaacttcccctctgggtcctcagaggtggggacccaagcaggcaaggatgggggcaccagccaggcctttggtcttcgggccctggccagtgctgccctgctcaccagcccaggggccaccagccaaggcccagcagctgagggacacgcatagctgcccacccgcagctgcccccagaggggaccggcgggaaggagcccactcctctgccagctgactgcctgctccccgcagagagcggatgggctggaggcctggacctctggaggggggaccggggctccgtgcctgggaaacggtgtctgggaaggaggaatttacagacttctgtttaccaaaatgaggcctcgtaaaacatttaacagcagccaattaaagggggacagctgtggaggtttaacagtaccccccaaggccctgccccttgccctgccactcccctacccccgccccaggtcgctcccaccccgtccctctcagctttggtcgaatcttccaggattggagtttaatctggtaaacagctgctccagatgcagctcccacacagaccaggccagtcggccaggctcgagcctcagccccgtgtcctcagctggagggcagctgcagggctgcaccagggccagggcgccctccccaggttcccagacttggcctgggatgtgcggcctcacagggagatggggcttcaccctgtcaagcaggcctccgtgtcgcaggacttcccagggccttccctgtgctcacgccctacacgactccaaatgggacgtgtgtggggtgcattcttggagctggtgacccagagcttgggtttcctggagcatctcctggggctcaagctccacagatttccctgggatccactgagccagagaggatcgaacagtgcctgccactgctgggggacccactgggattgcggtgtggggtgccccagttggactagggggcctgttttccagggaagattcagagcaggagttttagagggtgagggccccccgccctgccccgcccagctgcgttcattccggcaggttgaagctgtgggttgcctcaaacgtcttctcctcaggcctacagaaggctgccagacccccaaccacagccagccgctcggccctcacgttcaggcagctgctaaggcaggccggccggcactggcaccacctgcactgcacggagggctggggctggggctgggcgggtctgagtctcagagctctgccagtggcctggggtcttgctggggaaccagaagccacactccttgtggctggtgtccctggtgtccagcagacatgctctctgcagcccctgggctgggttctggtgcctgcaggcctcccaggccatgctcagccctgtcctgacctgccagctgtgcttcatcccttgggtgggggcaagtgtgccccacacagccagagctgtcccaaggcccagggccagccgcgtgggtggctgggtgtggctggctttcctgtgctgggcaggggcaggccgctcagaaatgtggctgccttgagggacagacagaccccttagccaagagaggggcctgtctggcatgactcggagtcaccgcctggggttttggggctggggcctgtgcaaggaactctttgcccccgtcccttccccaccctgtgcagatctcagagccggaagaggcctggccatggtgggaactcggcgtcggatggacacacctgtgacctccagccagggtcgggggaggctggccacaccccagcagcactggcccctggcctgggctgtccactgggccctggggcctgccttggggaggccaagtccgggcctggttctcctttggccagggccttggcgcagagtctgtccaccgtgccccctcctcccacaaaacctccccagagtcccttttgttgcccagcctgggagcttccgcgatcctgagtgctgctaggagggaacagaggccccctcgtccgtcctcccctctccccagcccatcagcaattcaatttgtgccgcaccggagggatggcattagtggagtcagagttaatatgatgtattgatgggttgatttccccccggcggctgcgtgctgggctctgcgggacatcgctcctgggctgcctgccggcttcttgcctccctggggtcagggcgagtgtgggccagggggctgggagttgcctctgcaactgggtctcttgcttctctagctccggggtaccccagattttcggggagtctggcatccaccttcctacccgtgagccacttggatcaccatggaaacagcaacgttctctatgggcagcaccgtttctatggaacccaaaaaggcaagtgcagcatgggaccggcgtggggagcaggcatgctggaggtggggagggggcgcaggagcttctggggcacaagggaaaggccagcctaggttagccctcccaccaggtgtcatcgaggccagggtgggggctagaggagagggtgggcctgcccctcaggatttaaacccaggggcccaggaccacccccaggcgcaggttcagttcccaggtcacgctgtctcaagacctctcactgctcaggtgggagcagctgagctggtgcccaccttcctcatcaccctagccccaccggcttcctcaggacctggccttgccctgcagcccccagcagcccggggatggtggggtggctcaggaggaggatgcatcctgtgggggctggaggaagcccacagaagcccgcacttcctggcttacacacccggtggcctcggctagacctgggctgcacgaggcccagcccccagcccccagccccccagccccgtgtcctggtggacagaggggctgctcaccccattggcagcaggcatccctgaagaagggatgcagactttgtctttgctgagaagtcagagccggtggggccttggggaagaggaagctcaggcccagcagagccgagtcctggtgccagcgagtcccctcagggtaccggagagggcctggctggaggtgggatgggtgtgggtccttatctccaagttgggtttcctctggtagggcgacatctcatttgcattttaaaaagttctccttggggtgacaccaggaggctggagcaggaagccatcggttagttaccaggttccagtgagaagcgatacaggtgtggggccccacaggggccggcatcggtgatatctaggagggagattgggggcagggagggatagaggggtctaggtggcccccggtttctggcctgggctatgggagggtgcacctggggagcagcagttggacggtggggtgagttctgcttcagtgcagaggggctggggcgtctccccaaggggatccgagaggtgtctggacacacggggtggggtcagtggggaggggtggactgggaggttgtcccgactgtggagagggacgcccaggctgtgggggatgagaagggaggtggggacagatggtttccgcacagctcctgggagcccgggagcccaggagccctggcgtttagggctggagctcagggtgggggcagaggagaggcccagaaaggcccccacagggcctgggaggcggactagacaccctgaagggaacagagggaggggaccccagtgagcctgtgctcatgagtggccatgatgaccccaactctgagtgtgagctgtggggtagggacccgaggccagtctgcccaccctctcttggctgcccctcagccccttctccccacctcatactcactccaggacctctgtgtggcctgcacttcctcgcctgcaggagcccgagatttgctaaggctcaggagggccttggccttgcccttgtcagccagctgcaggggagcaggcatgggggccaggaactcaccaccagccccacccaggggattcagctctcacccaggacaggcacccaaaccggtctcctcaccccacaccccagctcctgtggacgggctctgctgcccagaggacagccccgcaggccccgttcccctagaaccgcgtcagccccagcgcgtgcagttattttgacagtgtttgtcaggggcgggcaggtggcgggtcccaaccccagaaacccaacccctccaccagcacaggggactccctctgggcagtgggccggccaggcctctcggctttcacaatattttggtggagctgtgtccaagaacagtatttggttttggaaatggagctaattaggtttcgctggggctagccccttcccgctccccttcccccttgtttctaattagcaggaaattgacaaggaatttacatgcctgaggacaattttacaagttccaaatgtttcttttgtttctccccttgtcagctccctctgctcttggcaccaccctgctgcccacccacccagctgggtgtggagagggacagcacccccagggtccccagaggcggtggcctggccccctctgtggggcgatgggtaaccccagggcagccgggagtgtggagagcttggggcagaccctagccgggaagggagggcccagaccgagggcccaggctgggcaaccgtttcagggaccccagacactcaccccccaccaggcagggtgagcacagctgctgctctctgcccccggagccactggcctttctccatttcaacatattaccctagccccagcagcctgagacacccagatgagaggccgaggggctgggagctcccagggtgtccagcaggtgggtgagcccttcctccgcgacccacccgtccttcctcgcctctcctctgggggcgccaggagctgcgcctgccacctgtccctggtttccaaggtcttggtgcctgtttgtaaagacccagcagagatgctctgtaacactcactgcctgccccgcgtcccccgaaaatccactgcctgccccgcgtcccccgaaaatccccactggcactgggccaggcaggggagagactggcctcgggtttgcatctcccatctctgaggtgtggggagctgaacatgggggcagagggtgagtgtttcacggggacagaactgcggttcggggaggtgagaggttctggccatggatgctcgtgacggctgcacggcagggggagtgtgcccagtgcccctgaactgtgcaccaaaaatgggaaattttatgttacccatatttcactacaattttataaaaacaaaagcaaaaaccagcccggcgctgtggctcacgcctgtaatcccagtactttgggaggccaaggcgggtggatcacgaggtcaggagatcgagaccatcctggctaacatggtgaaaccccgtctctactaaaaatacaaaaagttagctgggcctggtggcgggctcctgtagtcccagctactcgggaggctgagacaggagaatggcgtgaacccgggaggtggagcttgcagtgagccgaggtcacgccacagcactgcagcctgggcgacagagggcagagcgagactccgtctcaaaaaaaaaaaaaaaaaaaaaagagcaaaaaccttccctaggctgtaacctggagtcagtgccagctggtgtccgggaggcacctggagcacctgtctcagggagtctttctccagcctcacccctaaggcctcccattgaccttggctctttcccacacagataacttctacctgcgcaacctgccgccccagcccacgctgctgccggccaaccacaacttccccagcgtggcccgggccgcccctgcccaccccatgggctcctgcagccgggatcgagaccggggtgaggcaggctccctgcagaagggccccaaggacttcgaccgcttcctcgtgggcaaagagctgggcagagagaaggcgggcaaggccgctgagggcaaggagcggccagcggcagaggaggacggtggcaaggagcggcacaagctggtgctgcccgtgccagccgacgggcactgcagggagggcggccccgcaccccgaggggcctgcgagggccgccccaagcacctcacctcctgcctcctcaacaccaaggtgctcaacggcgagatgggcagggctgcgctagccagctgtgcagggggcatgctggggcggcctggcacgggggtggtgacctccgggcgctgtgcaaaggaggcagcaggccccccggagcccgggccggccttcagcgagtgcctggagcggcggcagatgctacaccacaccgcatcctacgccgggccacccccgcccctcagcacagccgccggctccttcccctgcctgcagctgcacgggggccctgacgggctctgcccgctgcaggacaaagccccccgggacctaaaggccagcgggcccaccttcgtgccttctgtgggacacctggccgacaagggccgccccttccaggccgccgaggcctgtgccgtggcaggggagggcaaggaccggcacctggagggaaccatggcccccgaccacgctgcaccctatggagtctcctatgcccacctgaaggccgagggcaagggcgagcggcggcctgggggctttgaggcggccctcaacccccggctaaagggcctcgactatctcagcagcgcaggccccgaggcctccttccccggactccctaaaagcggtctggacaaaagcggctacttcgagttgcccacctcttcacaggactgtgcccggcctggtcaccaggacccgctgggcgggaaggccccccaggcctgctgcactttagataagactgttggcaaggaagccccggccggccccccaggggcacagaaggtggcccgcatcaggcaccagcagcacttgatggccgccgaggtggagcaggggggcattggggctgaggccaagcgcaagtccctggagctggcatccctgggctacagtgggccccacctgcccccatggggtgtccaggcaggccagggcaccgccatggccatcagcgaggagcgcaaggctggcgcctacctggacccctttggcagtggcctgcagcaggcggctcttctgccccaggaactgcctgcgccgccggacgaggtctcagccatgaagaacctgctcaaatacagcagccaggccctggtggtgggccagaaagcacccttggtgggcctgggtggcctcaaggccagctgcatccagcaggaagcaaagttcctgtcctctaagggcccaggccagtcggagaggccggactgtgcccgcagcagggagcacgacaccacgcacggcgacggggaggtgcggcagccccctgtgggcattgcagtggccttggcccggcagaaggacacagtgagccggtctgaggcagcctacggcaccaacactgcgcggcagggccgggccgcccccgccttcaaaggtacaggccctgcacagagagggaggcaggccgggacagtctagggggcccagctggccctgccctgcgccccggctccccagctcccacacctgcccttggcagaccctccgaggccccaggaccaggggatcctcctcagtgcatcaggccccccagctcgaagcggggtcactgcttgccttagctggtggctccctggccgccccaaccctctcccgtctgctgtctcgaccctgtgcaggtggcggtgggccccgttccacacacgcgctggacctggaggctgaggaggagaggacgaggctatgtgatgaccgcctggggcttgccagccgcgagctgctgctgcagtgagagctgggcctgtggccctggagagtggggctaggcctgggcttggggctccccactcagagccacgtggagaaagaggggtggtcatggctggggcagcagattctatggccggccgtgggtggggttctccccacccctagagcctttctggagtctcacccggggttgggggtctcagttaaccccttgcagcggtcaggttacccactttcaggggccaggagatggcccccagtcagccctgcagagcactgaggctggagcctggggttttccctgagcctccaggtcccgttctccctcccaggttgatggcagggggtgggacagggagtcaggcattggcaccgttggtggggctgagccccaggtcttacagagacaacaaagggccgggggtgggatggggagctgggccttggcgccggcggcagggctgagccccaggtcttacagggacagcaaagaccgcgtagagttcgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggtcagtgatccaagggcgggggctggcctggggctgatgagggttccctcctggtccccgagagtgcgaggcctgaccactgtgccctctgcctcccaggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttggtaagggcccctggtccaggctgctgtacttggggggtgctgttggaaggaggggcagccgggggtgtgctggccagggctcaggagggagcggtgggcttggtgggctgaggaaagggtggcggggaagcagccccggagctgtcccctccccagccaggctgacccctcctgggccctgcccacagcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccaggtaccgcccctagccacgctcacctgggccgggcacttctccccaaccctgcctggccggacctggctccaggagacccctgcatgcctggcctctggcaggatgaacccaagcagggggcccactggggtcaggggatcctgagcctgaccgagcttgcccccatccctgacagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccaggtgagagtagccgcctggcccggcccactgtgctccgctccaagccctcccacccctgcccggcagggctgcgctgaatccgggctgcctgcagggaggcgccacacctgcccagacccagggcagcatggctgttcccttcctctctcttccctcttcccagtcctcccaatgaccttgggagaagcacacagtgccccagccgcccccttcctggccgtgggctgacgaaggcgggaggaagacggggtcccgctggctgtcgtaggggccctccagcaatgaaggcggggcctgctggtggtggtactggcaccctgggggcactgggcatgggacttgaccaggctgccattcagggtctcagcaaagctgggagagggaggggcagcgaggcggggtgcctgggtgggggggtctcgggcctggcctcggcccctgccacccgcccatccactccccaccagcctatttgattctctctgagtgggactgagaggtcacactggaaaccgtgtggcgaacataaaacccgtcctagtttcacagtcaggagatggagctagcagagggtttttccgtttttttcccttcgttttttttttcttttttttgcagttaatgggacatgatgcctctgacatgctgccggcttgttctggttcagggaaaaccctgattaaagcatcatgttttacaaattcccccttttctggttacccacagcataccatgccagagatggctcctgaggccacccccagccccggcagccagggttgttggggggagcttcaaggccactctttaggggaatgagggcctggcctcaggctgctcacaccttttttttttttttttttttttttttttttttttttttgagacagggtatctccctatgtcgcccagtctggagtgcagtgacgcgaacatggttcactgcagcctcggcctcctgggctcaagccatcctcccacctcagcctcctgtgtagcttggaccacaggcatgcaccaccacgcccagctcattgttctttaatttttttgtagtggcacgtgctcactctgttgcccacgctggtctcgaattcctggcctcaaatgatccatccacctcagcctcccaaagttttgggattacaggtgtgagctactgcacccagccaggttgcccccttaattaacgtaaccctttccccgccaccagtcttgcagacctgcagctagcccagggcccttccgcacgggcttgggtctgagggttcgaggccactgtcctccgtcctatcgcaggacaccccctcaccaccactcccagctccctgctgacctgtcccctcctttgcagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctaccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccaggtaagcccggtggttgccgccaccccccagagtcccagcagtgggacccacacgcctgcctcagggtcacctggccagacggcagccttgggccccgctcagttgtccccaaagtgtggtaggtcccctggagagtgtccgcctccccttgccgtccctcgtccatggaagtccgaggcaggtgtgccatctccgaatctctccgtcccaggtggggccctgggagcaggactaacctccatggtggtctcagaggaagggcctctcgggcagcacctcctgttggaagtggctgaacaggggctcgcgtcctggcaaggggagaggagagcctgccgcctgcctcctgctctgccaggcctccacctcctcagcctccacggctgctaccctggcctggggggtccagttcaggaaccgtcggctccccgcttcaggcccaggggagggggcaggaggctggggctcctgctgcagggaggcctatgggactgggagctcctgggctcttccgcccacccaggggccccaaggacagccggacaacagtgggcgggtccagagcacctgggacacccgagggccaggtgtctgcttcgtccaccctgggccttggtccgggcactccctgcggtccagtgctcccgggaaagcgcccgcttcctgccgtcttccctgtgggccccagagaaagccccggggtggagggcgtcccccagccgggcacggcgccgtggttgttgatagcacgaagctgacagtcttcagggctcggccgctgctttctggatgcataaagctcaccaccgcgatgaagagaatgttctcgaacagtgcatttccccaggggcccgtggtcaccctgtgctggatgaggctgctggcccgcacgcggcaggggtggttccgcagtgctgggagctgcctgccctcgggggtatctggcccagagtccctgcttctgggtggggctgtgcagagggtttgaggaagcttggagtcctaccagggtgggctccacctggaccccccagaggccctcccttgggcctccagctggcaatatatgagaagttagatagggcgaggtggaggcaccttggggcagggcctgagctgccagggacccgccgtgggagggtctcagggaccctcacctggcagcatgaggaggcgtcagtagatagcaggtcccgtgtgtatggccagagtggccggtctgcctgtgtgaatgcctgcaggacaggagcccgttcactgcatgaatactcatgtgtagaccacgtgtcccgggtggtgggccatgtggcttaacccagcatggatgtcgtcacactccggccaggccaggtgtcccaatccccagggtgtgcagaagtggagtcagggccagctctgccctccgggtctccacctcatggtccccccctgggcccccacccctgcccctgccctccccttgtccccgttaatgggcaggtctctgcagctgctgggctcagagctgatccctacaagtgtagcgatcacttcaattgaaattaattaggaggttggttttgtcctgtgccagacagcaagatttgcagagggggaagtggagaaaaagcccccaccatcggggccgggcaagcatagagcccccaggactggcagaaccatctgggtgaggccacgtgggagccacacgcctgtagcctgcaagggcaggggaggcacagaggggcttctggccaactgcagtgaccccaggagacctggggccttcagtggaaggggcctgcagatgtgcctccccggctgctgatggcagcagctgctcagcccaccccccctcggccctctctccccctcccattccctgcggatcctggacccagcagcctgagtgttcccttggtccccatcagatctgtggtctcggtccagagctttgcaccccagcatctgcccctccgagcacctcctggcttcttagtaatgacttctggggatggatcaacccttggtctgggcttgtggccccctggccctccccatacttgaggagggaagcagccacgcaccatggagtgccccagcctgggcgctcaggtcagtgcctttggtggaatctcaggtgcgtgccccagctgtcaggcgctgatttgtcccatcgtggatggggttctcccgcactcctgcttctggctgagatgagccatatctctggggagccccggtccgttaagtggagcgtggggttctgaggcagagactaggtttggggtgctcgttgctgtgaggttatcgttgctcctgggctttcccaggggataccagcacctctactcaccccacaggggttccgcagttctcctgccttcctggccatcaccacccacccccaccgcaaggtgtctggctcctgtctcctgctggatgtccttgtgggatcagcccatggggaccccgttcctggtctctgtggtcagccctcagggctggcttcccctactcaggccctgagtccccaacctgggcccgaccctgcatggacgccagcctctgctggcccatgctctgaccccaagatgggccatcccttccccaggccactgcctgggctgttgggctgccgctgttcctgcggtcactgtgagggtagctcccctgtccctgcccccaggttgaggtcccagaggatgcggccctggcagccccttcctcctgacctgtgttcagcccatggccctcctgcctgccccagggctggagcgtgctggaaagggcttggcagagcccagcactgtgttcagagaccgggcaggggcagggatttggtgctctgagggaggatggaggaatggtggctgctcctctgagaagggtcacagcagatgagactgcatccagaaacccctgcccgctgccctcctcacaaggaatcgagggcctggggtcccagctacccaggaagctgaggtgggagggtactggagcccaggagttcgaggttgcagtgagccgtgatggagccaccacactccagcccaggcaataaagcgagaccctgtctcaaatttaaaggtatcgaggggacttgtcccctccctctgcactgaccactggcctccctgcagccattgctctttaggtgtccacacaggcgagtggacggaaggactgatgggcagatggacaggcaatggcaggtcttagctgctgggggacgccagcctccaccacctggatggagtgatgcccaggtgctgaagcccctggttccaaagccatctctccgcgtgactttgaacttggttgaagccacgtagacagacgcctgttggaaccgcaggcttgagccacagcattcaactcggttgaacttcagcagcttccgtgcacgaggcctcagtgggctctcgtagcactgcctgtgtctctgagggccccagagtatcccttcccagggctgccgttcgaagcagggcccccccggtggggggacacacaggcgtttctgttagaagctgtaacgagcagattgcttttacttcgatgctttggggcctgtcttgctctgtgacacagaggaccctgccccgtgggtcctcccagctggccctgccttaccaccaagggagtgtctccccagcatgcagcaaaacaggggtgctgggtgtcagccctggtgcccacctcactcttcccggtctcctgaccctcatcccggtcttcaaggctgggtggcttcagggggccagggctgacatcaagagcctgtgaggggcagtgtgtgcccagttatgcccatgctgaccttcccatgccgcacagaggaggaagaggacgtgctagccttcaacctgcagcacctggccacgctggccacagcctggtccctggtggaggccgctggcctggacagctccactgccccagcgcagccgcccacagccaacccctgcagcggccccaggctcaccccccgcatgcagatcctgcagcgcaaggacacctggacccccaagaccaagcctgtgagtggaggtcccagtgcccacgtcgcccagtgcgttgccacagagccccagcctgggccctggcccggctcacaggcccctgtgccccccccaccaggtgtgccccctgaaggccgccatcgaccggctggacacgcaggaggtggggatgcgcgtgcggctggcggagctgcagcggcgctacaaggagaagcagcgggagctggcccgcctgcagcgcaagcacgaccatgagtacgcctggcgtggcgggggggcctgggagggtcgcagcacccccacccccgggaggcgcccacagtgctggggccgatgtgggaacaggccaggattgggctctgccccctacctgtgggcagacaccagggtccatcggggaggccccccagaggcagtggggcccaaggagggaggcattcggccagcagcgagaccaagtggcagggccaggggtctgtggaagagccgcttgtcagagcctggtgtggcaggaggctggccgcagggtggcgggtgaggggacagtggcagaagggggagtagggaggactgggggtgctgtggggccagggcagaagttgggggattctctgggggaggggacaccccgcagttgcaacaagggcaggggcaccacctgaccagtgtgtgtggatggtaggaggtgggggcggcgggggcccctggctggccttgccctctgcgtgaggggtcaggctccccaggccgagtctgggccgcatctttccccacacccagtagccctcgaaggccaatgccctcggctggaaccttgtcggggagctgggttgtgcatgagcctctgaccatcccccctgcggcccccaggagagacgagagttcacggagccctgcacggcgggggcctggccggccgaggaagcgcaaacactcaagctcgctgcctgccccacgtcccacggggccgctccccaggagcgatggcaagaaagtcaagtgagtcctgggcactggcatggcagggcgcgtgtggccggccctgggccctcgaggctggggagcagggtccaggctcccctgaggcttccaggctgctggtgccccttcacacctactctgaaggcctggccctgcccttcctagaccatcgagagtgaccagcagacagagccctgctccagacaggctttgcccttctggcagctcccagcaccaccctggcccgggtccccctctggaagtcacggcccccaggcccagccacgccggctctgcacacctggctgtggcatcgtccccgcccggcccccctggagtgtgaggcggtgttgcgtgcaggcctctttatctgcactgtataaagtcgttggtcacgctgtggagctgctcacggctgccggcgcgatgttattatccattacccgcccggcgcagtcgttggcgcactcccgggcctggtataattgtccttctcggctacaaattgcctctcccggcaggcccatttgcataaatcctccgagctcctccaaacacgattggcgcgtgcgtgtgcgcactgcatcaatcctgatgatttggtaataatagttaaatcggcactaaatggttccttcaattaagacaggcaaaaaattaatctcagggcttcatgtcacaaaacattagcaaatgcagagaaggttacggggaggggctgtgtggctgtgggcagtggaggggtcaccatatggctgcccccccccagagctgcccctgccctgcccaggtgtctcctgggggggggtctcctggggtctccctttgagaaccagccagcactgtgggaactgctgggcaggacagggcccctggaaaccaggatctggctagaaggcagcagcctcaggacagggagggaaactgagtccaggacccctcttcccgagggtcagggccccacctcacccttccacctcctgccctcactcatccaggcagtggtggcagaggcagttggccccgggacgggccttctaccatgcaggaagtcggggagcgggggcccaggggtgccttgtggcccatggcttcctgcctggcccctcaggcctcagaagcccagcctcctctgtgagcaggaaggtggaaagggacatccggccacgccaggccagggccaggcagggctctttgtctccatctgggattcattttcatgagcagctgggtatccctttgcacctgtgggcaggtgggggttgaaaggtgagaggccaagcccccagcccctgtctagccaagaacaggcagagagactccccaagccttggcttctccatgtgaaatggggcagtgggaggttctggggagggtgggtcacccacacaagagggggagcccaggatgtggggggatcaggtgggacctgttttggggcatctggaggtagctgctgggcccatgtaggctggagttgacttctgccccagctcccagcctgggggacagcacagctctggggcatggggaatactgaggctcagcctccgcagtgtccagggctccatctgggaggggccagggatgcagaattccatccttaagacccgcgtggaggacagaatgggctcctgagagggcctgagcccggcaacggggtccctggggactcaggggaaagcccaggcttctctggacaccgcccccaccccaccccacccacctgcccctacccccgcccctggtgggactccggttggcacgtcctcttccagctgtggcggaaatgtgggtgcagttctcacaaacctgcccggtgcctgccccactcctaagggtggtagtatcaggccctgaacacccgccaagggccgggcccggcctgcataagccctgccccagactcagacaggcacatgtgtggctgtcccttgttccaggtgccaaggctggggctgcagccccactcaggccccagtagcagcagagccctggctcctgagcactgggcggcccctcagagccctcaccggccccagcccccgacacctggcctctgggtcactgtggctaggaccagacagcactgccagggcgttccttcctatcaggctggaaggatgggatttgggtaacagaagcgtgcccacttccagtatagccaagtgggggatggggcggatttgaggatatagggactgctgagggccggtggttggcaggcagaggggctggctgcaggcaggtgctcagaggaggtcagagctggctcggcccccggggcccctcaccccctgctctgtctgcccgagacgtggggcccttggaggagggtgacccacagtgtgacccactacagagacagtagggggacaaggctggggcggccgggcctgcatctgccctgcacccaccaccccatgcccccagggcggtgcggacaagcctgggtctgctgtgtgcggagctgcgaggaggcagtgggggcgagcctgcgaagaagcgaagcaagctggagaggagcgtctatgcgggcctgcagactgcctccgtggtgagtgccgaggcgcccgccttgccccagggcccttcaggtcccttcaggtcccttcctggcaggtagcagactctccccagccctgtgccgaaacccattgctcagatgagcgaagcaaggctggggagctccgagcgccgacagcaggaggaggagggtgaccctgcggtgtaacacaggaaggtctgaccgggtggccctgccgccacttgcccacgtcactccaccctcctcgtctcactccagcaggaaagcaaatgcccaggctacactctgctcacagagactccctggaacgaggccctgcctttcttcaggtggcccagggcacacttggtgtggcgggggctcctccggctgccggcaccccctttcttcttggtgtgggggggctccccacgctgctggcaccctgtttcttcttggcgtggtgggggctctctcggctgccgacaccccttctttcttggcacaacagctgcctcctgcccctcctctctccgtggcctcggcggggctggtgagacgtgggccccagcatacttcacctgtctgcccagggggctgatccttctgcccagatgctgttttatccctccctttagaaaagctaacagcctggccccacaacccacagccactgggccctcagcctcctccatgtcccctacgtggggtgggcagttggtgggcagtgggttgtgtgggaaaggccgcagcgtaggctccaggggcaggccctgtgtctctgggccagacatcccttcagcccctgtggatcgagggcaggggcctcgaggtaccagttctgagccgggcatcaacagagaggcacctaaccgcccaggggctgtggtttgcagagggcgccctgagagtgcagctgcccctccctgttcacaggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcaagttgctggcgtgagtggccactgccaggagccccggtcatggtcgctcgggggctggaggagggggcggcaggttcatggccgccaccagggctgggtcatggcttgtggggtgtgacaggtccaaggagacgttttcactgaacaggctggggaaggagatgaaggtctcacggaaggagacccccatccccaggcagagctcagtggctcagcatgcctcacccccatgtcagggccgaaggggaaggaaggacccccactggaagcatccaggttaaaaatagccctctcaacggccccagcccctgtgactgtagcatccggctgagctgaccctgaggcgttatctgaccaccccccccagcaaacacgtgtgtccagaaacaggagcctagaaaaatagaagcttcctttcttctgccagccccttcccccaaggtctcagatgcctgagaaagaacaaagggagggccgcttggggctgggggaggggcagagggccatctgggcggaggacagcagaaaaaggggaagggactttctggggagggggccccagccctgcctggtgggtgccctattgcccagggtataagaaaaaaacacccctccccacacccatacaaatcccttcaggctggaggccaggacctcaggcacctgcccccaaagcagccccacagagcggcccagagggtgacggtgaccagctccactcacagccccgccataaccgcatgcccagagggtcacctcccccacctctcaatggcacagcttaccatcaagtcatcaggacccctctgcctctctcccaggcagtggctatgacagtgaggactgcgagggtctcctggggacagaggcaccacccagggaagcagggctgctgctgcacaccggggccagtgtggccgtgctggggccctcaccctcctctgtggtcaagatggaggccaaccagaaggccaagaagaagaaggagaggcaggggttgctaggtaaccaggagggaggacaggggttgctaggtaaccaggagggagggcagggattgctagataaccaggagggagggcaggggttgctgggtaaccaggagggagggcagggtttgctgggtaaccaggagggagggcaggggttgctgggtaaccaggaggaagggcaggggttgctgggtaatcaggagggggagggcaggggttgctgggtaaccggggggagggcaggggttgctgggtaaccaggagggggagggcaggggttgttgggtaaccggggggagggcaggggttgctaggtaaccaggagggagggcaggggttgctgggtaaccaggagggagggcaggggttgctgggtaaccggggggagggcaggggttgctgggtaaccaggagggagggcaggggttgctgggtaaccaggagggggagggcagaggttgctgggtaacccgggggcgggcaggggttgctaggtaaccaggagggaggaccggcacagtcagcccaaccagccgggtctctaggatggggacccctgtgacggcctcctctccttcccacaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcgggtgaggctgggctctggggtgctgggcggagagggtgggtgcctgtgaggaaaggccttccccgccctcccccgcacgctggcccctgagctctgggtcaacctgaggctgtcccacccttgactcagccccttctctgcctgcccacgcgcagcggaagaacggggccctgtccatcacgctggccacacgcaacgccaaggccatcctggggaagggccggaagctgagcaaggtgaagcacaaggccggcaagcaggtagcagccccccactctgggagcccactgtgcacccacctgcaccccgcctgcaccccacccaagcctgactcctctggcccccagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctaggtgagcagggccaggaagggtgccagccgcctggggaggggtggtgggtaggccgtgccggccgctgacaccttgtgcccacagcgcgctcgtgtgccatccacaaggaggacctgcgggacgggctgcccgtgctcatccccaaggaggatagcctgctgtacgcgggcagcgtcaggaccctgcagccacccgacatgtgaggcctgggcatggtggggcagggcaggggcctggagggcaaccgagacccgtggcacctcacattccccaatgcccccagctatagcatcgtcatcgagggcgagaggggcaaccggcagaggatctactcactggagcagctgctgcaggaagcggtgaggaccgggccggcccgccccggggaggggcctggctggcttgtcccaggacaaaggaaggccttggcctgggccgcagccactcccaggcccagggaccagactctcaggcagccctgggccaggccccacctgctcatgggtcgtcgcccgcgttcctgcaggttctcgatgtgcggccacagtccagccggtacctcccgcccggcacgcgggtctgcgcctactggagtcagaagtctcgatgtctgtacccgggcaacgtggtccggggtaagttgcacccaaagcgggggctggggcaggcccctctgagacccacaggctcatatctgcccccaacagcctggcttccgaggctggcgagggcagaaccagctctctgcttagacagagtacgacaataaaatgagctccccaggcgccatgaaaaagcacagggtgtgtggggagggagggtgggggctccggcctccagccaagcagagagggcccagcaggaaggggccctgagcactgctgctgggggtcacagagtacgtcagggggcaccagctcccctgggcaaaacctcctgactacaggcaggggcatgtaggtccctagggcgaaaggctcaagggtcccacaggcaagtggccaggtgggcgggaggcgcctccaggcgggactcggctgggaggtgggcacgtgggcgtcagcacgtgtggggaggtctggttctgggctgggtggggtgacggtggcatcacatgggaggcactgcaggaggtggagaggaggcccccgctcctgggctgcagggcggctccactgtctgtgtggtcagggagcagaaccccagagccctcccctcaccctccccaccggctttggcagccccgcctccctgtttcgggcgcctactgggggttccagctgcaagctcaggtgtgccgtccacaggggcctccggtgacgaagatgaggacctggactcagtagtggtggaatttgacgatggggatacaggccacatcgccgtctccaacgtcaggctgctgccccctgacttcaagatccagtgtgagcctgggagctgcacggggcagggccctgcctgggctccactgtgtccagacgggctcccaaggaagggttggggtggcagtcaccccacagccatggcactgaagcccttggcccatgctatccacaggcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtattttaccggacttcccagaatccggatcggggaaggcaccctctgggggctgggggaaccaggaggcccgtggggtaggcagggtccggggaggggcaggtggaggcagctttgtgggcccagctggggctgactctgctgggcttttgccctcaggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaagaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacaggtaggtccagcgggaggcgggaggagctcctggttcccaaggaaaccggggcgggctcatgcgcccctgctgcccttccctctcctttttcatcttcctacttgatttcaagttaaaaaatgtggaaaactcaagggaagaacaaagacccatccatgacccagtgaggcagccgcttccgctggcccctcgctggagcccgtggcctgcgtgacagtagaaatggcttcatgtcgggccgggcctgagctgcactccgcatggtgtggcctcacttttccacgttgataagtggcgtggccagctggagagctgtgtatccccgcactcagatgcctgcgtctgtcctcaccagggcactgctcgggggcgcatgtggggccactcgtgggtcttttgccttcgtaaataacactgtggtgaacgtcttgtccacatgtccctgtcccagatccagtgtccagacgtcatgattccatgtgcgggctccgtggaggcgtggcccctgctccagatccatggctgccatggccttaagccgcggtgctgcggcttcctgcccttgtgggcgccctgcacactcacactcagactcacactcacacccacaccacaccctccatgcctcctggccgccacctgtccccacagccccccggcctctcagagccaccctgcccatgtcccccacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaaggtgaggcccggacaggtgtggggcccagcccccctcggggccccagggaggggacacgacagcagccagcactgtgccccaacacggagcacctggccccaccacacagcccccgctcagcaggtaccacggccctgcagggagccgcacagcccatgggcatgccctagagcagggctcccaggtccctccccacagtggggggctgtggcccacagcagtgctcagcatccggcaggtctagttcactcctgggatgtgtggcggcccccaccccgtgggccctccctgcctccagtgccagcctgagacagaaattgcactcagcacaccctctgctcctctctgagaagaagccattttccagaccatatgacacgtccatctttcagggaaattagtatttctctgactccgacagcccccagagggtccccggcaggttcctcggcctctggacagacagggctgcctggacctggtccctggcaggttcctcggccccgtcttccggccacacagaagtccatccggtgacccttacagagcatgggtgggcgggtggtctttcctggctgggcaggggcgcactggccaaggccggccactgatgccccgcgcgccttgcccccagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgcccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgccccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagggaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgtaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttctttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggtt

SEQ ID NO: 657 - DNA, 64 bp, Homo sapiens
cgcagggacggatcctctcgggcggtcccctctgactccctgcccgagaggatcagtccttggc

SEQ ID NO: 658 - DNA, 2897 bp, Homo sapiens
attggttacggcagcacttttatttttccttacacaatgacgtgttgctggggcctaatgttctcacataacagtagaaaaccaaaatttgttgtcatctcttcaaagaatcgagaattgcgtacaaaaaaaaccttacataaattaagaatgaatacatttacaggcgtaaatgcaaaccgcttccaactcaaagcaagtaacagcccacggtgttctggccaaagacatcagctaagaaaggaaactgggtcctacggcttggactttccaaccctgacagacccgcaagacaaaacaactggttcttgccagcctctagagaaatcccagaacactcagccctgacacgttaataccctgcacagatcagaggctgctggccacacagactcaccaagccacagacttgtcttccacaagcacgttcttaccttagccacgaagtgaccaagccacacgtactaaaggttgaactcaaagatatgtacagggtattaaacaaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggtgtgtgcatttgccaggggcaaatttctattctcaattaacccatgcagcaaatgctacgcatctgctgagtccgtttagaagcatttgcggtggacgatggaggggcccgactcgtcgtactcctgcttgctaatccacatctgctggaaggtggacagtgaggccaggatggagccaccgatccacaccgagtacttgcgctctgggggtgcgatgatctgcaaagacagccaggcacggcttcagctcacagagcgccccccagtcagctctcccgagccaggcagagggccaccaacccctcgactcaccttgatcttcatggtgctgggcgccagggcggtgatctccttctgcatcctgtcggcaatgcccgggtacatggtggtgccgcccgacagcaccgtgttggcgtacaggtctttgcggatgtccacgtcacacttcatgatggagttgaaggtggtctcgtggatgccgcaagattccatacctaggggacagagccctcccttagtgatgctgtgtcaccgaggatgtaagagtagaaacctttagctcacaacacctacccaggaaggaaggctggaacagcgcctccggacaccggaaccgctcattgccaatggtgatgacctggccatcgggcagctcgtagctcttctccagagaagaggaggatgcggcggtggccatctcctgctcgaagtccagggcgacgtagcacagcttctccttgatgtcgcgcacgatttcccgctcggccgtggtggtgaagctgtagcctcgctcagtgaggatcttcatgaggtagtcggtcaggtcccggccagccaggtccagacgcaggatggcgtgggggagggcgtagccctcgtagatgggcaccgtgtgggtgaccccgtctccagagtccatgacaatgccagtggtgcgcccagaggcgtagagggacagcacggcctggatggccacgtacatggccggggtgttgaaggtctcaaacataatctgagaagggacaaggggcggcttagtcagggacagagacccacggccaccccatgctcacacgccacaacatgctgcatgccagtgtgatgtgtggagaaaagaaaagaacgcaggcagaaaccaaatgagaaacctggaggcttcagggaggaaatgccgggagaggaacagagcctggaacagcgaaagaaacacttaaatgtcagaaatcaagccgggcagaaaatgactggggaaaggacgggaggagcacgggcgtcggccgagcctcacctgagtcatcttctctctgttggccttggggttcaggggggcctcggtcagcagcactgggtgctcctccggggccacgcgcagctcgttgtagaaggtgtggtgccagatcttctccatgtcgtcccagttggtgacgatgccatgctcaatggggtacttcagggtcaggatgccacgcttgctctgggcctcgtcgcccacgtaggagtccttctggcccatgcccaccatgacgccctgcaggggacgacccgtcagcctcgccggcgacaccgaacccaccccgcaacgcagaacccaggagccccgcggcgccatccactcacctggtgtctggggcgcccgacgatggaaggaaacacggctcggggagcgtcgtccccagcaaaaccagctttgcacatgccggagccattgtcaatgaccagcgcggcgatctcttcttccattgcgacctgcccggaaaaggatggactcaggcgggcgcgtctgtaacacggtcccctccccacagccacctaatgccctcccgcggggaagcctcggccctgccccaaccccagcggccgtggcctccaagatcgcaaccgcctggaaccgaaggccgggccttttacgtaacgtccacggctcggaagtctgcactgcggccgggccccgccctggacccccggcgcccccccagccccgtccgcctgacccggcccaccccgccttttgttcccggggaaggcgcgacgaggcctcggcagctggaagcggggccagccggggtcggggggcgcaggcctgcgacgtccagctcaggccccggggcggggcgctcaccggcagagaaacgcgacggcggagcggcggaagaacagagtgcgagagctggcagcggcgactgagaccgaccgcggcctcccccgccgttatttaagcggaagcggcgcgcccgcgcggcccggcggcgcgc

SEQ ID NO: 659 - DNA, 12486 bp, Homo sapiens
ctgaaggttcacggacagacagggtcgtttgtcacagcagagaagcacctcacggctcctacccgcactcatcgcggacagtgcctgcagcgggagcggcgcgagcaccctccccagatgaaaacaccagcaccaggaggtgggccgtagcccaggctgagggaggaggctgggggctggggctcagggcccccccccggccacagcgccaccctgagtggccctgaaaatagtgcacagtgctgggtactgccccggccggaggcacctagttgttgagcattccggccacaggccacccgctggcccttccttggtgtggcacgagaccacgggcacttgcaggagctccctgcatgctgttttgtgctttggtctcagggagcaccctcctacctcggggtcccagagtgggcagccgggcaggtgtgaacagtgtgacaagggtaccgtggggcacctggtagtgccacccagaggggcagccggtgctcctggtggtgtggcagcaacagttacaaactcaccccaagtccaaaccccagaaatcctgtttctctggccctccgggtccagaatgccctgcactgcctcctggcctcaggggctgctgcggtggtgggaaggctgcccagcagtgaggaaggcgagtgcaggggctgcggccgcggtcagagaaggagagacaccagcagaggacgcgaagctggaccggccaggttcagagcccgcctcggttgctcccaatcagaatctgctttgtgctccacggcctccaagcactttcatgagcgttctgctcctacgtggccaggtcctaccttccctgacggctctggccaggccagctcggtttccctctaacccatgaggcctgggggggctgtgacagaggctggaagcgtggccagagcccaggggcaggcccgcctggtcacagcaggatgaggctggggtggcgcagctgccggtacacctgtagcagcctctgggcggtggcacaggagctggcctcatcctccgtgcagagccggtcgcgcagggtctgcacctcccgcagcagtgtctgcaggtgaagcagacacagctcaggccccccacctggccctggggatgtcactgggtacctctgggggacccaccactcgcaggaccctacttgggaagtggcaggtggtccgaggaagaacactcatccggaaccttaaaacatgggacacgcagcctggcccggacacccagcccctcaagtaggatgaggggcaggaagagccatggccgctcggactttgccccaggcccatgggagcgaagcccatgcgctgtgaggactctgcggaccccgagtgactggaggggggcctggcgatgggcgctcctggctacccaggggaaggggactgcccggggaaccgggtgctcacctcgtggttggcgtggatctggcggaggtactgcacacggagatcaggagcgctggagccctgggcggcctgctctgtcaccatcgtctgggggacacaggagacatgctggagagggtgtgccccagcacctgcccccacaccccttgaagcagggtgaccctctccctctagctgcctggtgctgcctccctgcctggcacccctccccaccccagcgctttgctgttttccaccttgctgttcatctcgacttcctgccctccagagcggcagggcacagagcccctggcctgacagtttcttggaagcgaactcgtttggttcttttctctccatcgctgggatcttccctgtccccaagagccacactctgtgcagatccagacctgcctactgcccccttctcccatcctgggcttcaggcctgaaggccgctcaggagaacagaccagccagggagctgcctcggcgtcttgtgcagagaccctggcctggccattcactcattcacgcagcccagcccagtgtgggctgcagcactggctccctgggcttggatctaaattcccagatgggaccaggtgtggctcagacctgtaatcccagcactttgggaggccgaggcaggcggataacttaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgagcccgggaggcggagcttgcagtgagccgagatcccgccactgcactccagcctgggcgacagagtgagactccgtctcaaaaaaaaaaaaaaaaaaaaaaaaatatatatatatatatatatatgaaatcagccaggcgtggtgacagagcctgtaatcccagctattcgggaggctgagggagaattgcttgaacctgggaggcagagggtgcggtgagcagagatctcaccgctggactgcagcctgggtgacagagccagagctctatctcaaacaaacaaataaaactaaatttccagatgagcctgggcagtgaggctcctgcaggctcttggagcaaagcaactgtgaagagacgacaccctgaggggcagcactggcctgccgggggctccagaagtgctggtggctgcactgtgtgctgggcagggtcctgatcactcctgttcctggggcgggcacctagctgttgggggacactaaggtctgcagcctgagatgagatctgtgtccaggaggcagcagcagtgcatgggctcctgggcgctgactcaggccccccagattcatgcggaagccctagtgccagcactcagagcctggctgtgtctggaaatggggtatctgcagatgatcaagatgaggtcactggggtgggtctgaccccacacgactgtgtccttgtaagaaaagggatatctggacacaaacccaggggctggagctctgctcttggcaggggatgggactttcttggggaccagatggtccagtgggcagagtttcctctgacaggcaacacctcagctctggagaaccccctggtgcccccagcactcaggactagacccccaagcccaggcagccccatcgtggtgccgtgagatcactggggtcatggtgctgcgtgacatgctcatcagggtcatggcagtgtcacagtgcagggcacagggtccttgcaccaaatgagatctctgggtcatggtgctgcgtgagttgatgtgttcattggggtcggccatctgagccacctgccagggctgggcagagccactgttcacagaaaggcctggtctccaagcattaccacagtgcccacgggagtcaagctggcgtcaggctgcaggccctgggtctcagggttgggcaggcctgggcatgcacgttgataacaagcccaggtggagctgaggcagggaccacccctaaaaagaaactccggaaccggtttctagggtcgctgcagacccaccatatgggccaaagctgcgctacagtcctagcgggcgggcgtgacggatgccttcccgcgggcacgagcttagactttagcttggaacttggagagcttcttctcagatctggcagccgctgacccaagctggctctgggcacagcatggaagcagctattcctgtgccagggaactcctggggctgtgagtggggggaactgcaaactccactctcttggcaaagatgtggaggctcctaccacctcgttctaggatccacgcccaggccacggcctctccaggcagcctctgcccagccagagaagggaggaaaccttgggctgacctcgcaggtcacaaatagaaacccactggccttgtagcccgggcagtccttggactcacaggtgcccagggggtgacggcacacctggggagcagcattggcctcctgagagggtccaccccatgcctctcatcgcccacagctccactgcacaacaccgcactcagcggcagagcggacttggatcttcctacaactcccttgcagggagccgcagaccccgtggccagcagctacagggtcccatgcagggaccttagtgagcgacccacagatcctggccaccttccccagcgggccgacatacctgcatgcgcccgacaacggcatggtgcgccctgcaaatgtcggccagagaggagctttccacttgaatctccacggcctggatgggccctgctgggcacaggtcggtcatggccacctgcaacacaggagccacctcactgcctgcctgtggcactcccacctgcccggggggctcaggctacacaggagcctccccagctggcagcacgtgaggccctgagatggtcccaaccccctgccctgggctgtcctataccctgaaggagcagagctcagtaccctggtttagctttttccacctgaagaaccagccaccaaccaatggcaagaacctgctctgtacccagatgtgtccaggaagacaccatccctcagacctgtggaattcacgcagggcctcgagccagactggggcctgctccagaagaaggccactactgtgacacaccttgtggacaacctacatgtagatcctgccacgcccttggggggcccagatccgtccccccacaccaggcatcacagatcacctctggcagcagggttagggcatcgctgtgggcactgggagctgctgggcctatctatgggacacccacctgtcccttaggaaggttggactgagctgagatggacaacaaatggcaagaacaggccaagagccaggaagccgggcttattctgcacacacagcacaagaggtgagacgccaggggcctggggagcccagagaggacacagtcacctgcggctctcccacaggggccgccagcaccgacctgcagggccaccaacagaccccagcatcagggctgaaagggctgtgtagagggcagccaaggtacccgagggccgaggcttgattccaagtgcagactctgggccgggcacagtggctcacgcctgtaatcccaacactttgagagggtgaggtgggcggatcacctgaggtcaggagctcaagaccagcctggccaacatggtgaaacccccgtctctactaaaaacacaaaaattagctgggtgtggtggtgggtgcctgtaatcccagctactcaggaggctgaggcaggagaatcgcttgaacccaggaggcagacgttgcagtgagtcaaaatcgcaccactggactccagcctggagacagagcgagaccttgtctcaaagaaaaccaaaaccaagtgcagactctgagccccaggcagccttgcccatcctcagggacacacgtgtcctggcagcctgggctaccctgcaagcgcctttgctggtgggacttgagagtgtgctggaggcaccacagtcctgagtctctggaaaggtgtgcacgacaggggctggagaccagcagtgccatttgccattcagcggcttccacgacaggtctggagccttctggcagtgcagagggttagcggggctgctgctcctggggtagaggtgttggtggcagcactgtggaacccgctatgacttcagtcctgtgcaggggaaggggacccccatggcagacagggatggacagggccagtccttggggatctgagctgcaaggccctccctgcctgagtggggtctgcttggtgcgaggggaaactgtcatatcagagtcctccgggaagcttgggaaaaggctgccaggcccccacccagggtgaggggtcctcccgagctccggcccaggggccccaccccaagaactgctggtgccgtggctcgtttccctgaacccctgcttgcctctcggacgatgaggtgaacgttggcgccatcaggggccactccctggatggaagatagtgctcgggccctcacgacgtccacagcagcattctcagcaaggagccactgcagggtggcacagcacaggggcacgcctggaggggaggcatcagccgagagctcagcctgatcctaccaggtgggctcagccgatcctaccaggtgggcatctgcatacctgccccaaagtgcccttcccagagccatctaagcatcccagctgtccccagccccaccctaagctgcggcgtggccagctgacccagaggaaggaggccactgctcaactttctctgctgaacaagtcctacgatgggtggtggcagttacgatctgtggaaggtgaaaacctcactttgggggacctgctaatgctcctgggagccgatgttaggagcaggcagctccgcccggcactgggcagaaacaccccaggggatggctgcggctgccctctctgcacaagcccaaatccagaaaccatccaaatacccatctgcagcagaacggtgacatctgcacctgcgacacagagggtctcacacacatgggggagcaaaggacagacacaaagaagggactgcacactccatttcgtggagctcacacatgcctgatgaacggtgctggggctttggggtgagcgcagctgcctccctccccgggtgcccgcactgtgaagctcacagtttgctcctttgtgactcttctgtatttaggttacgcttccatatataggtttaaaaaacataactgaaaagaaatacatggtgagagggctccacataaggccagagcccaacagcagagagaacgcaggcgaagctcatttcctgagcagagctcgctgggctggggggccaggatgccccaggagcagctgggagagggaggaacagcccatgtccacaggcccgaggtgggtggggtgaagtggctcatgcaggtaatcccagcattttgggaggcccagaggagatcaattgaggccaggagctcgaggctgcagtgagccatgattgcaccactgcactccagcctgggcaacagagcaagttcctgtctcttaaaaaaaaaaaaaaaatccccaaggctgagcaaagccaagcagtgccaccaacctgagtggccgtccttcaaggcagctctgagcagctccgccgacaccttgatggaagccacagatgggggcaggtactcggcccgcagggaggcgggtcctgctggctggctgccaggctcccgacaagtttccagaaaagtggccacagggtctcgggtggggccgagtggggagggggcccgtgtgtgtggcagggccaggccagggaagcgcagacactgcagcatgtccactgtgtgcctgctcaggggcaggcaaacaccctcttgctcgggcaggacgtcggaggggcactcatccagaaaggggtcctcagagtctgagggggcaagggccccgcccaccacctccctgagactgtagaacagcgtgcaggacacggtcacgggcaggtcgagcccgccgttctcaccagggcccaggggtagcgtcacctcccgccgagcaccggggccgagctggtccacggggatggtgtaggtgatggcggagcaggccgagtccaggtcgagagcacaggagctggtgagcacctggatgcacagggtccacccctggtccaggctgaagctgctgctgttctctagcacgcaggtggccatgagcacatcctgtgtctgcaggcggctccaggtggtgctggtggtgcaggagatgggtctggggcccgtgccgcttgacagcagtgcacagctcacgttcatggcctcgttgaggcttgtcagtgccttgttccgctggtcaaccgccttctttagaaaagacactctgcgaaggacagacatgacccccgggagcggggggacacccacagcaccaggtgccacatcttgactcaggcctggtaggcaccgagcctggctccacgacaagcacacggtgggtgtggagccacaccagagagtgagcccccgccccaggggcatgtttctcccggccccacccacaccgagcctctctggaagctgcctccagccatctgacctgacctctcctcttgggccacaggaggaaagaggacagaggatgaagctggtgctccggggacctaggctaatctgccaggtatgagaagcgcaccacccacatctgggccacgcaggggccgggtggtgcattaccccacccttggctccccggaatgttcctagtgggcctcttttctcccttgcagccttcacagtgaaaaccaggggggtcgcaggcgctacagaaacagccctaaaccacagggacccggagtgacaggcccctcgctctcgggaccccagtggttatgtgaggggagcaggggaggctgcgcgcactcagtgtgttctctctgaacgtcccgaagccagtgctgcgggaggaaaagcacactggatcctgtgctgagagcagggagggtgaggactcagcaggggacgtctcccgtgccccactagggagaaagggtgggctgctggggggcagtcccggcttatcttccagaggtagccaggtagcctgtcaccaaacagtgggacgcatgaggctctcaagacatcttaagaggacaagtaacggccgggcacggtggctcacgcctgtaatcccagcactttgagaggccaaggcaggcaaatcacctgaatccaggagttcgagaccagcctaggcaacatggtgaaatcccatctctactaaaaatacaaaaattacccgggcatggtggcaggtgcctgtaatcccaaccactcaggaggctgaggcgggagaatcacttgaacccaggaagcgaaggttgcattaaaccgtgatcgcaccacaacactccagcctgggcgacagagtgaaattctctctcaaaaaaagaggccaagtagggtcgggcccggtggctgacgcctgtaattccagcactttgggaggctgaggcagacggatcacgaggtcaggagatcaagaccatcttggctaacaaggtgaaaccccatctctactaaaaaataccaaaaattagccgggcgtggtggcgggcgcctgtagtcccagctactcgggaggctgaggcagaagaatggcgtgaacccgggaggcggagcttgcagtgagccgagatcacaccactgcactccagcctgggtgacagtgtgagactccgtctcagaaaaaaaaaaaaaaaaaaaaagaggccaagtaatggcctggcctggaccgttgccacccgaggacactcacacccaggacgaccccacacagggacgctacctcccaaggatggcagcgccagcctctacccggtccgagctgagctgctcacctctcagagatgttgccaattccagacagcagctcctttattttctgacctgcactctctgtggtcatcctggctgggccaggcatctcagagtccaggtccaggctgcaggtcatcaggcggcctttggcggacagggccaggagcttggtgccacctggtgacagacacacatggggcctggtcagcggctgggaggggcaagcagcatgacactcggtggtgtttccctggactccaggaaagaagttggaagacggccaaggccagtgtccagtgaggaagagaaagtcccaaggcaaatgcactgtcccgaccctgggcttctgtcagtggccccgagccacgccatctctgatcccacccgtagccctctcttccgcagtggagacagtctggcgtttcccttcaaagcccttctctcctgctgtgtatgtattttctgtggcgagatttattagcatgctcacaaggtgagcacacttggggaagtgcactggtaggaggtgtgtggctctattcctctcaccccaacactgggcacacacagctaaaaccctctctggctttttctgtggaaaacacaaaactagaattccacaatgccatctgcctttggtccagagcagactcacgggcaagccacaccatgacacgagcaagcgtttgcagcctttggaagaaaggcaagtccggaacagacctccctgggctgcttgccacataagacctgcccaggaggcgcttgcggtggacccccaagatgcagtttcctccaagtccacagccagcaagcagcaaactcagatcctaccaggcccagggccacaccctagaccccagaggcagagcaacaggtaggcccaccaccagcccctggcttgaccttgagacaagagagttaaccactaggctgtatcagcacccgtcagccttgcaaaagaacaagcccaggaaaggaaggcggcctgatagtagcagacagccaaaaagggtgctccaccctgggctcccatctttcattttagacagcagctcataccttcatgcgtcctgggagacgcggacagcgagacgacactgcagatgttcaggctggctgggcacagcatggggggcaggcctcccgggccttcttcgggctgctcagggcccagcggggtgcttccccgagacagatccaccacacagaggtcagaaggggtgctgtggtacacgcggccacccccgccacaggcagcgcagagcacagggcctgggaggcagtactcccgcagctcgggcaccagcttcccggactcatcccagctggccttgatggccagcatccggccgtggtgaccaaaggccaccaggcagtcacagtgcacatcctcgtcaggcagaaaattctctgcagcttctgcagcctgtggctctgtcttcaaggcccctatgaagatgacgggctcctccaggtgatggaggatcttgacaagggcatttgggtcaccaggggctgacctggaggtgaccagggccttcaggatcacacagcagagctggccatcagggagaccacagaggaccacaggtgactgcaggagggtggcatcagctccaaagaggagcccgaagagggcgtcctccagcgtgaagcccccggagcccccgaggaggtcgtgcgggaccctggagcctgatggtgacacagagcacagcactggaaggaagtggggggctgcaggctttcctgggaccccggctgggggcgtgtaggaggacagctccacctcaccgatctggcctcctggccgggggtcctccccaggacagggctgctcaaacagctgcatcttccatcgggcagggccctgcaccagggtgaccagcacactgtccagcaaggtgaacgcgcacagcgcagcatcgggaaggatgcaggcatcggggtccacagggatcacgggggaaggctggtcaccgtcctcgctgtccctgtcatcctggctcgtagacctttgagaacagggacgcactggtcaggcctgggcagggtgggattcccacgttctcttcacaataacctggcatggagtagtctggctcaggggttcccgcagtgacccccaaggccgctcagcagtccatctgccacgtggcctcccaccttccccacgaaggatactcttgacaagaagtaccaggcatccaaaaccagcgtgaaccgacacctgtcagcatagaaccgtcaggctgaggcccaggctgcaaagtgcacaggctgccccctctacagcctgggccgcggtcagcagctgctggctctgcactgaagacaggcctggctgcccggagctcgcttccttccaacccagatggtgtccactgatcactgactcggggtcacggtgcctttgctgtctcctccctccaataaagacccaacctcgggggcgtgtctcaccagacagcaccgggccaccagggcccaaaggacaggatcccgcgccccgccgtgggcttaaccatgtgaaccccacttactaaggactgtgagcaagacacttgcagaaagagtgctgggggcaggggctccagataatcgggcagggatggcggccgaggcttcagagctggcggcagcccgggtccccaagcgcgatgaggtggggctgctcgctctgaagcagtccgggggcagcaggagtgtgcgggagggaggccgcgggcccgccctcacctgctcctgcccgggtggtccagcgacaggcagtagaggcccctccgggcgcacagcgcgtacagcaacctgcgcggcgccagcagctccaggtgccacacctggtcggggaaccggaacgccgcctgcggaccggggcgcgggtcaggccgacgcgacgcgcgggcccgcggtcttcattttcacgcgaaccgccgcccccgcccggtccctcccgcccccgcgggccggcgctcacggtcagcagcccgccctcctggtcgtacacgtagacgagctcgctcccggtggacaggaagacctctgcctcatggcacagcacgcggggcttgcccgccgccaggcccccgagagggcagcagaagcccgccaggtagcggacccgcggcgcggcgccggccatcgtgcgcgcgggcccgtcagagtgaaaagccccggccgcgcggcggcggctccgcctcggagcgctttacggc

SEQ ID NO: 660 - DNA, 2897 bp, Homo sapiens; identical to SEQ ID NO: 658

SEQ ID NO: 661 - DNA, 4622 bp, Homo sapiens
agcaggcagggggttcgtgacgccggctgggtctgggggctgtgggccagccgagccgacccgggcttctgggggaccgcgggggccgtgagcactcagagggcgcatcccaggcccctccggggacccggccagcctgaagatgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggtagggagggcacaggtggcgacctcctgaggggtgctgggacccccctgcttcagggaggaggccgtgggggtctcacggggagtggtatcgtgtctgtgcgttcacatgtctgttctgggctgggggtccatgtgggacatgtgtggccactcagggtgtaggtgggtgggcctcgggccatgcccaggcgacccccactgaggggtggtggcttcagggtcagaggcaagggttcctggcctttctcagcatagctggagaatgtctcagccaagccctgggcagctgcggagtctgagactggagaggtgtgggccaggcgatgggcagtgcccagcaggggcaggaggcccacagcctggcctggtgccatgaggggcatgtgggcaggaggctgtggggggtccatatctccccttctttttctccaccccattttctggacttcatttatttatttattttttgagacagagtctcgctctgtcacccaggctggagcgcagtggcgtgatctcggctcactgcaagcgccgcctcacgggttcacgccattctcctgcctcagcctcccgagtagctgggactacaggcgcccgccaccacgcccggctaattttttgtattttttagaagagacggggtttcactgtgttagccaggatggtcttgatctcctgaccttgtgatctgtccacctcggcctcccaaagtgctgggattacaggcgtgagccaccgtgcccggctgcattttctggactttaaaggaaattggggaggagcccagggtagggcagggagctggggatcgggcggggatagcaccaccacgtgcctgaccagtggagcctcgtgtcctcaggagtgggggggcttaaggtcagctccagtgatggaggacacggtgggcaggcagctttacccggggcctgggctcctggtggggaggcacctccctgccccagtggggcgtggcctggctctccccagttcccaggtcaccagttgcctgtctgtgtgactccctccaccgcctatggggtgaaccccagcagttcctccttccccacaagctgagctctgagggaaaagccctggcccgggcagtcactacccacctgggctcctggctccatgcaccccagagtggctcggaggtggtctgaaaaggcgaggtggggagagccgggtgcatggagctcctcctcccaactcaggtccttccagaccagcatcagctgggcaaggagagctcccctgtctcctggcagctcccaggtgcccaccaagcccccaccctgacggatgtccaggccccctgggtacactgacactctggggccagatggcagaggccccaccctgtgcatggagaggggagcccagccatggctatggggtcctgcacctgcagttggcatcctcgggcctgtcccagcagtgacagggtcccaggagtgagaattcaactgtggatgcacggccatggcccttccttcctatcacagcccacagtccagctgtaatgcctgctggcctgggcccaggccgggcatgtggcaatccttaggtggttaaagggggtaagtgggacagtggcagtgagaatgcttcctccatggaagccaaagacactagacctttaggcatttgtatatggacagcttggaaagcagactcaaagtggcagtcatggccgtggccgtggcattgtggtgtgatgtgcatggtggcgtggaagtggaggtgaggacggtggtgacagtgtggtggcagcagcgacaatgatggtgatggtgatgatggtggtgatggtgatgatggtggtgatggtggtgatggtggtgatggtggtgatggtgataatggtgatggtggtgatgatggtgatggtgatgatggtggtgatggcggtggtgatggtgatggtggtgatggtgatggtggtggtggtgatgatggtggtggtggtgatggtggtggtgatgatggtgatggtgatgatggtggtggtgatggtggtgatggtgatgatggtgatggtgatggtggtggtgatagtgatgatggagatggtggtgatggtggtctccatcaccaccatccccatcaccatccccatctctatctctaccatgcccatcaccatcatcaccatccccatctccaccatccccattaccatctccaccatccccatctccatccccatctctgccatccccaccatcaccatccccatctccatttacatccccatccccatccccctcaccatcctcatccccatccccctcaccatcctcatccccatctccaccatccccatctccatcaccatccccctctccatccccatccccatctccatcaccatccccctctccatccccatccccatctccatcttcaccatccccaccaccgttcccatcacctgcaccatcactcccaccaccatcactgcctcggccatgaggattgccgtagcagctcagtcagaaaggaaagcccactggggcagggtagcgcctgatggtggtgggtgtgtcagtggagggcaggcttctgtcccactccttggaacctgaggaggatggggaagtgagaccctgcacccccatctcctgctgtcctgaggagaccttttgctgctccctccagttctgccaacaccatgtttgagatggagtggcgtggccggcgggtagcactcaaagccagcaacgggcgctacgtgtgcatgaagaagaatgggcagctggcggctatcagcgattttgtcggtgagcactctgcctgccaggtactggggcaggggctgtctccacccagggaaaggacctgcccagacaccccatctccaccaagagctggaccctccccagcccacggaacgggtgctgtcatggagtcatacttgctagtcaagataactcgtcttggcaagggaaacaggtctgagtgtccttatctccgctgctgggaaccccctaggcgccttgccaaggccgcacatgaggcaatggcaggcctgggtccctaagtccaggtgtggcgtttcccagggcccccaccccgcccggcctggacagggaaggtggcgggaggggcagcgcagcagacgctctccccgccaggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgaggtgcgtggcggggcgggtgggcacgcgggagcgggggtggcagcgggcaggtgggcacccccgccgacgccgtcccgtcccccaggccgcgacggagggttctggtacacgggcagccacggcagcgtgtgcagcgacggcgaacgcgccgaggacttcgtcttcgagttccgtgagcgcggccgcctggccatccgcgcccggagcggcaagtacctgcgcggcggcgcctcgggcctgctgcgggccgatgccgacgccccggccgggaccgcgctttgggagtactgaggccgcgcccagaccagcctgtcgcgcattaaaaccgtgtctctcccgca

SEQ ID NO: 662 - DNA, 4622 bp, Homo sapiens; identical to SEQ ID NO: 661

SEQ ID NO: 663 - DNA, 12486 bp, Homo sapiens; identical to SEQ ID NO: 659

SEQ ID NO: 664 - DNA, 2897 bp, Homo sapiens; identical to SEQ ID NO: 658

SEQ ID NO: 665 - DNA, 18191 bp, Homo sapiens
tcctcgcggctctagggccggcgcggtgacgtgcgcgtgcgcgcactggagggaaaaggcggaagcggaagtcggggggcgcgccagctcgtagcaggggagcgcccgcggcgtcgggtttgggctggaggtcgccatggggcgaggcagcggcaccttcgagcgtctcctaggtaacgcgtccccacccgacggctcggccttggtcagcccgcagcctccgcccggcgctgagtcagcgcggccccgagggcccgaggggcgcggaccggccgccctgcccgcctctccccggcccgctgtcctcccgggttcggagccgccgatcctggaccctcggcgcggccgtggggtcggcgtccgtcgggcgttggcaaatggggctctgcgagggtccgcgcagggcgccaggggcgctcggcgacctcgctcctccgcgggcccgggcattcggccgatttcctcttgaccgacgagcacccggccgagtgggccacaaggcctgagtcatgaaagtgggtgactcagtcggatgttaggctcgcacttgggcttctgacccaaaacactgggcctcgaagggtggagccggcagtgttctctctgggaccttcgagctctcttgggggctgcgggtcccagacccaccttttgttcccacactggcttcgggaagtgcctaatggtttaggaaggcgttttctcacgtttttggaggtgaaagctgatcctatctgagcctcctggaattgacgcgttttgggagggaaacgaatgttgatgtgcacgtgcccagcagcacgtggaaaatgcgtctaatgtttgggggtaggagcttgggtggtcgaatgggctgcccaagcttgcctttttgtcaagtagggttttcaaggagacttcaagtgagacaccttccttgccaagggaaccagcaagcagactgagtatctcagccacacaggtagttcagtgcttcagggatgaatccagaggttaactactgaatcagtatagaaagtggacgtggcttggcttgttagatcgtttctgtatccgggaaaggcgatgtgggcagagctggagctgcccccccagaggggccagttgttggagacagcagtgatgtggtatgatgacaggtatgctggcgagtcctccttggagccccgttctgcccttatttccaaagcacttggcttggagcaaggggcctggagtctacactgcaggcctctctagcccttgcccaagctaaggtcccattgaaaccgggagcatctgggcgaacggggactccaagggacgggtgatagggttctttgttgagaagcagccgagcctgatgtttaagagtgaatcagcctctgtctctggtgagctgtgtgactcacggcagtgccctcgcctctctgctgagtgtctttacctcgctcgcgggttgtgggagggcttggaccagcacctggtgtgctcttacgctgtttgctgcttccctggggaggatggcacttccctgcccatcagcacgctcaggaggattctgtcatgctttttcatttggtccaaatgtctaaaggggaaggagagagtcccccccagctgctgccaagctggggtgctgcacggggcgtccagcaggataacccctccctttcatggcattttctctctcagacaaggcgaccagccagctcctgttggagacagattgggagtccattttgcagatctgcgacctgatccgccaaggggacacacagtgagttagcggggcctgtgccctgatgcggaggagcagccgtgcactaagctgggctcgcttggtgcccgttgggtctccacgacgtagctgaccgtgttaggctcttatgtggagaactgcatgggctacatgctaggattttttgacatcttggaggattaaggggttttctctgtacagcttgcagatacctggttatgtttgtatttgcttcggggttctcaaagactaagatggcagacagacttttttttttaagacggggccttgctttgtcacccaggctgaagtgcagtggcgtgatctcagctcactgcagcccctgcctcccaagctcaaacgatcgtcccacctcaacctcctgagtagctgggactacaggcattcaccatcacgcccggctgattttttgtattttggtagagatgggtttttgccgtaatgcacaggctggtctcagactcctgggctcaagcaatcctcctgccttggcctcccaaagcactgggattacaggcgtgagccactgcacctggcagcagatgagcttttctcatcttagttgctgagactatttttttcccgtttttctctgcttttatcaatgtttccttttcagagcaaaatatgctgtgaattccatcaagaagaaagtcaacgacaagaacccacacgtcgccttgtatgccctggaggtaagcagacccccgtgcctcagtggcccccagggtccctaccccctactagtcacgacagcatgagaagagtttgtcctgtggccttgcccacctccctgggcatacatcaagcaggagagtttccactcagccttgagtgcctgtgtgaacagtgccacctaggagagggtcacgctgagggagagacaggagataggggagggagtgggcaccacttcttcagccggtcctgcgtgagtaaacaccagaaggcggatgtcattgctgtgcttggcagtgagacttggcgtcacggagcggtgctgtgcaggctgctgagtctcagatgtgggttccccactggcctgacgggcctgttgaagggctgctgtcccaccgggttccccaccggccactgacgggcctgtcgaagggctctgctgtcccaccgggttcccctccggccactgacgggcctgtcgaagggctctgctgtcccaccgggttccccaccggccactgacgggcctgtcgaagggctctgctgtcccacagggaggtgggtctgtccgggaggaggaggggccctgccctgaccactggcccaacccttcccttcctgggcatctgcaggtcatggaatctgtggtaaagaactgtggccagacagttcatgatgaggtggccaacaagcagaccatggaggagctgaaggacctgctgaaggtgggtgagacgggggcatgcgggtggccacccaggctggcacctttgcttctccgggtgtttactgggcactgatgacagaacagcaccaggtgtggcggaaaatgtgcaggtgcagatcggtggtccctgcactgcgcaagctcgcactcatgagtcggagagacagggccgtgagccccaatccagggaggtcagggtttagcaggagccggcctggggtgctgtgtctggaggaccaaggtgacagcgaccctggggcctgggggaagcttccgggaggcagggcttgggcacctgctgtcttagggaaggtgagtagatgccactgggtgggcagggcaggtggtggctatcgtgtgtgagagtggctgtggtccggagggcaggctggccacatcccacaggcaggggcctgggagggctctgagcgggggcttgtaagatcggatgtgtctggcggggataagagctgttttggagagcgagggcttcatgctttcctgggcagaggaggaaaagccctccagatccccaggagattgtgccggggacatctgcagggattgtgctggggacacctgcagggactgtgatgtggactgtgatgcagtggggatgctgttgcaggtgtcaaggagaaagagtgtcccatgtagtcaggctgctccccttctgtcccaacctgtgggccagacctgggtctcataggagactccctggactcacacagctgagaacctgcccggggatcccggtggacagccaggcctctcaaaggccctcactggccactttggctggcttcctgtcccgtcctgtcctggctgagaggcggaaggtgccggagtctggccctgcccgaccctggtgctcctgagctccttcagtcaggctgcagatcctgagccggttcgctcctctggggtgaggcagggctgtgaagggaaggcgccgctgaggatgcagaggggttctggaaaggagcttaggctgaggtgcaagtgccccggagcctgcttgcagcagcctctgatcgcacgccgtcctgcacgtcacaccgggacggcgtccccgagagggccgtagacgcgaggccaggctgcgctctaaccgggggagaggatggctgcagggggtctggagcccgctctgaatttggaggcatttctggagcggctgccccccgcgtctccccggctgtgactggaaggaggggcgtggccagagccccgcagtacccctgtgttctcagccccaacaccacgctgccaccgtcaggcctgccgggtcctgcctgttggaggctgacgggaaccggggatcctggggtgggcaggtcccgtggggaaagggagagacagatggtcaggggcacagagacgcggcgttgtttggctccagcaagtagaggcaggcgtgaggtttgaactcagggtctgggaacaggttggtgcatggcccccacgccccactcggggggccctccctggcctctgtgtcagccccatctgctcagaggctgaggtctgccagctgcttcctcacaccgaggcctctggcgcctggagtgtcctgcgaccctcacccccttctccctgcctgcagagacaagtggaggtaaacgtccgtaacaagatcctgtacctgatccaggcctgggcgcatgccttccggaacgagcccaagtacaaggtggtccaggacacctaccagatcatgaaggtggagggtgagtcaggactgaggttgggaccaggttgaggcttggaactgctgggcagtcaggctcaacgggcacagtggcgaggggcctgggaagatgggttgttccctgtgttgggagggaggagggcggtggcctggagccagggaagaccgtgcatgtgagggcgggttcagaccggctcctgcctttctggacccacggcccacgggcaggggcaggcagtgatggcagacaacacacaggtgaaaaggcagcagacagcctgtttcagagtggcaggactcctgggggccgggttgggctgtgcagtcagggaaggcctctgaaggagctgtcccaagtgtcgagactggaacagaagccagagccggcgtgagcaggcaggcagcacccgtgggcagacactcagggttgaggccccagggcagaaaggtggccagcgtgccagaggagagtgcagccgggcctgtgcgccgagggcctccaggctgttgggctggagttcagggttgctgtcagcgcagcaggaggcctctggtgggttttcgtctaggtcgtggctgccaaggtgtgtttcttaagggtccctctcggccattgtggccgtggagaactaggggattgtgtagagagaggtgggggcttcaggatgcatttgggagtcttggctggtgctcagggcccactcagtgagagagaggtgggcatggctgctcacatctgtgcgggttctctgtggccctgagtctgctgaagacgaggctgagagcgtggggaatggggcaggctccaggggtggtgcgtccccgctgcaggagttggacgcttgccctgtggctgcagggtgggcaggaccagtgtggagaacacgggaagaacgcagggggcgctgcacgagctgccttggaccctcaactttggggtggtggatgctggtggtctgtgctcctgtctccttcctggggtgggagctctcctggattttttctggggtcgtgtgtcaagaatagctcaaggtcttgtcctcaggatcagtgggagccctggccagagagcagagggtgagggagccactcagcaggcggggccacgcaggggcctcatgccctgatggagtgggagcagtgtctcaggaagagggcagcagggcctggctcttgtctcccgccacagtgaggacagaggccccatggggacacccaatcttgggggcaggaggctgtctcggtgcccccagacaccttcacttgggtgcacggtcactgctgcgttgcagctgccgagagtgaggaaggggctcccggaagtcttgcaggccaggtgggagcaggcagtgactatggcttcatctctccagggcacgtctttccagaattcaaagagagcgatgccatgtttgctgccgagagagtgagtgtgggcggccgccaggggttctggagtcgggctgctcaggaagcgtgaaggggagtgctgggagcccggcttgtttgagggttggtggctgagctctcgtctgtctgggacctgaggatgcctgtgtgtcctgggcggaggcgtagcagctgtctctgcagggcgaggtggagacgtggcttgagggcctttagagtggctagggggctcgggaaaggaaaacaagcacctttgatgaggaaggaagtcccttcctcaggcctcggcagcttcaccccaggccacgccgctgggaagggccgcccggggcattgctctcgctcgtgctggggtcctctctgggtccgttgccttctgtggggcaggggaggctctgtgcctctggggctggtggggcgggaagcgtgtggtcctgactgctgcccctcctcaggccccagactgggtggacgctgaggaatgccaccgctgcagggtgcagttcggggtgatgacccgtaaggtgagttcccacctggggggctctacagccccggccagacaccaggtcccctgccgtgcacaaggccaccgtccctgctgggcctttccttcctggtgggtggttcaggaggtgagtgcagctcgcagcgggtggcagtgtggcgtcaggagggggacagtgagggcccacgtaagggcctgatgccactgcctgggccgggcccagcctcactctggaattataatgttttaaacctagggctacaggccttgccacagtcactctgctgcttgccagggccgtggggcccccttctctttgtggcttagcccatctggattcttaccctcgaggcatcttcacatcaaaaccccctccaggctggcaaccggcagtgcttggggtttggggtgtcagcagcttccagcacccactgcactcacaaaagctcttgttttatcagcagaattgatgtgtattttttccttgcccttacttttaacttaccttattttccccaaaacggtggctggcgttgagactcccgggagcatgtccaggttccccggccttagggtcttcccaggcacttgttctgcttgtcccttgccttcccccacctgtgaggcccagcttcggcatcgtacggggtggttctgggccgggtggcgcatcagggtcccccagtgcctgtgaccaggcccgcccgccccatcttacagcaccactgccgggcgtgtgggcagatattctgtggaaagtgttcttccaagtactccaccatccccaagtttggcatcgagaaggaggtgcgcgtgtgtgagccctgctacgagcagctgaacaggtgagtccccgccccccatttgggctgcaggtggggcaggctctccaggctgggttttctgtccctcttggccatggtgcctgaggcctgcagaccccagaggaccctcacagcacagcagctggaaggtcaagggaaacccagggtggccgcatgccctcggaccctgccccacactagggcaggtgggtgtgagagacagggcgccgcggctccagggaccgaggctgccccgacaaacctgttgcttgggtttgggtttgggtttgtttgcatttcaactttcggaataaaacttacagaaaagttgcaagagtagcacagagaagctgcggggccgcggccagtgcctcagcggtgggaacctgcggggccgcggccggtgcctcggcggtcggtgttttgtcgcagagtttactctgcctcccctctcctgcgcgtgcgtgtgttcacacaggttttattttgaatttgcatgagtgcagatgtcatgccccttggcactcagatcttcgcctgtgatctctgagagggacagtgctctcatggccacagcagtcactcgggactgcgctgccacccagtgctggcttctgctctgtggtccacgttccatttctgccgtggtcccagcagcgtcgctgtgggtctggcctgggttgcgtgtgtttcgtatgtgggccgtgctccctgcttggttcccttttcctggaacgtgtcactgcctccctgtctcgctccgtggacatttctgggaggtcaggccgtggccacctggccccctgttcaggtctgaggctcccacctgcttaggttcgggaagctcaggagtgaggccatgccctcctcaggacatcccatccaagccagccatgtccggtgatgggccgctgcccggaaagttccttttccttcttgtaactgagaagaacttgccttgagccacgtcaagtcccgtccgtcgcagccactgcccacaagcgtgagtctgctgtgagccagcggctccatggcagggcatcccagcgccattcctgccttcacacacacttgctgccgtttccctgtgctgggggctgtgcaggtctgcctcggtgtggacttttctcttaggaaagagccccaggtcggccgagcacggtggctcatgcctgtaatcccagcactttgggaggctgaggcgggcagatcacgaggccaagagatcaagacaatcctggccaacatggtgaaatcccgtctctactttttaagtattttatacttaaaatttttgtattttatacaaaaattagcgggcttggtggcagatgcctgtagtcccagctactcgggaggctgaggcaggaaaatcacttgaacctgagaggcggagattgcagtgagccaagatggcgccactgcattccagcctgggcgacagagcaagactctatctcaaataaaaaaaaaagaaaagagccccaggtcaaaggtcagcgtgcgtggttggaaattgcgaccatgctgtgagcctgcggcccttggactgcctggggcgccccggaagagcttactgggcatgacagtcactgacctgtttgccccttcttgggtggggcccgtcccacagtggcggtgctgtgtttggtttcccgagtgccgtaggaaggtcttcgcaggccgggctggtgtcctgaatgtccattttcaggagaggaactggggcttaccctgagggactcacccgagcccttgtggctggtgtgatgccctcgagtcctgccctgctctgctctggagtgtggccattcggacacctgtggctgtggaaccactgtcctcactctgtggggacacttagaggagcccgcagaggtgtggttgagagctttggcgggggcagggcggtgtcagcgcatggtgacctgcagcattccttgtgcccacaggaaagcggagggaaaggccacttccaccactgagctgccccccgagtacctgaccagccccctgtctcagcagtcccaggtactcagccccctccgtcccgtgggcacctcttccccggcgccccccctcaccctccccgcttgtcctcagctgccccccaagagggacgagacggccctgcaggaggaggaggagctgcagctggccctggcgctgtcacagtcagaggcggaggagaaggagaggctggtaagccgggtggggcggggcggcctcaggaggggcccagctcccctggatgtgctgcggtggggccggaggggcgtcacgtgcacccaagtgacgccccttctgattctgcctcagagacagaagtccacgtacacttcgtaccccaaggcggagcccatgccctcggcctcctcagcgccccccgccagcagcctgtactcttcacctgtggtgagcggcccttgggctggagctccctctcctggaaggcagtagggttgatgggggacgcgggtccctgagctgatttagtcaggttggtgggggatgcgggtccccgggcttcccagagaggacagccccagcacacgggcggacatcagggcagagccccacggctccaggcacccgttgctcctggtccctggttcggcccttgggactgaggacatgggacaggctgtgggggaggcgccttgctggtgagaccccgtctcttccacacccctcccgccccacaggaactgaaggacttgctttctggggcatccacgtcacctctccctggcctcagccccgctctcagtagagggtgaagaggcagcctgttttgcagggggttgggtcggggacagcaggttgagaaagtcattttgtaggttccgtggagtggccaggccgctgcaggcccaggggtgcagaacagccctgccccagtgagccaccccttcccttcttcccttccttccgggctgtcggctggggccccacacgctggaccgtgggggctgtccagtgtccaccttgaggccccagggctggcccagtgccaccctgttcctcccatagcaaggttaggagccttgtaggacggcagtgctgtcagcctctgtggagttctaagcatctggaagaggagaaaagatggctgctcagatgccaggaaccagaggagggcacggagggagggcccaggctgcggctctggtctccaggatctgtcgcactggggacatccctgtccctgccgaagcaactggctctgtcacctgtgagactcagatgcccttttctccccagaactcgtcggcgcctctggctgaggacatcgaccctgaggtaaggcccagcatggggtgcatcctctcacggtttctggccttgggagtgaccccctcattgcctgcagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggaggtgagggggccactcccggcattcctagtggcagggtcccttggaaggggtggatgcgggacaggttggaggccccactcattctctctcttccagaaccccctcccggagacagactctcagcccattcctccctctggtggcccctttagtgaggtaagctgtggctccctccacgggccagggcaaaacatggcctcctggcccacagcgccaggcacatggcacaggtgcctgccctaaccagagggccgtgctagagcaagggtgtctgccccagcccagccctggcctgccctgccctgccctttgtggcctctcccaatggaaactctacaccaggctgtggtccagagctcgggccactctctgtggacctaacatggacctgaatattccagagcagcctagaaccatcagatgagtccttggcgttgcctggggcttgtgggctggttggctgtcagagcacaggtccctggagagggagctggcagtggggccctgagccagctccgtcctgaccagggcttgcagctggacaaggaccccgcctccagggcctcgccttcctcagctgtagaaggggctgcttgcataaggagcagatggactctgctccaggcttgagtatagctgggtgcctccatcccaggccccaccagggaggctggctggggcgtggccgcactcatccagaaccctgctctgcctgcagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggcgtaggtgcccgcgccacggggcctcggctcaggggcagccaggtgttgtgagcgccatcctgggccagggcctcccctgagggtgctgagctcttgtgagtccttcattggggccgtggcttcctccagagagtgtcaacaggaggtggtctcagtgatgaccatgccctgccctgccctgccctgccctgccctgccctgcccaggaccctctgcctgcctcccccagagcccagcaccttcagagccctctgcagaaggttgggcacagggcggcccatctgcgtgtccgttccacccaggagcttctcggcactgtgccggagtggtcagggttgctctgtcatctgcccacagtgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggtgcagtggctgcccagccacaggccggggccggctgggggacctcgcagcataaccagcatgtttttgccgcacaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccaggcatgtgccatcctcccgccacccagaggcttgtgggctgaggaccaactctcaccgctgtctcttttgtccccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctggtaaggacgggtcggggcagagaccatgccttttatccctcgtctttattttagccgaatttacagaaaagcagtaagaatggtgcgaagggttttcccagttgccccgatgtgaatgttgtccctgctttttcctgtttccatgcaaacgcactcacacaggctttcctgctggagccgtgtttcagtccgtgcgtggcaggtactgccctctcccctgaatgcgacagcgagcatttcctgaaaccagcaggtgctgggctgccgatcctcgtctgtagcaggctcagccctcatggactgtcccagtggtgtcctgtaaacagcacgccccctgctgcgtggcatttgccccccccccccccgcctttaatctagagtgttccccagtcagcttctgtgttttgtgacatctactgtcccaagagcactggcctgtcattcggcagaccgtcctcagctcaggtttgtctggtgtctccacgcggtgaccataaggctgtgcttttctcagagtggcagccgaggtgacgtgcatcccgtcagtcccattgctggccgttcggctgagacggggtctgccaggggttttcactgtgaagtgactgttttgccctttacagatgtctcttgggggaggccttccaaataccctgggactcctcaaggtctagcattttttgctaatgttgcctgtgtttattacggtgtttgccaaatagcgccttctaattctgctgttgtctttccactggcgggaggtactcttccccactctcctgcttatcgtcagtcacagcagcgtggagacgtgtttattttttctttcaaaggtgacactcctctgtcatcactctttatttttagagtctcgctgtcatccaggctggagtgcagtgccatgatcatggttcactgcagcctcgacctcctgggctcaagcaatcctcccatctcagcctcttgagtagctgggactacaggattgcaccaccatgcctggctaattaaaaaaaaaagggctgggtgcggtggctcacgcctgtagtcccagcacattgggaggctgaggcaggtgggtcatgaggtcaggagttcaagaccagcctgccaggatggtgagaccctgtctctactaaacatacaaacattaggtgggcgtggtggcacgtgcctgtaatcccagctattcgggaggcagaggcagagaatgaattgagcccgggaagtggaggttgcagtgagccgaggttgcaccaccacactctagcctgagcaacagagtgaaactccatctcaaaaaaaatgtagaaatgaggtctttctgtgttgcccaagctgacctcaaactcctgacctcgagtgatccgcccttctcggccttccaaagtgctgggattacaggtgtgagccaccgtgcccagccccgttactttgatgctcaaagtttcccaggtgtggccatgggaggcgtcagtggcttctctgttgcgtagggccattggtttgggttgctcctgagtttctgttgctagatactctgtgctcgtcttgtatgttctcaaccctggaagcagccatttctccaaggagcccttgttccctttagtggagggtggtctggatcttggttagaagccaagatcaagattctgggtgtgctcacagctctaggttgttagcagacagagctggaaagtgtgtatgtgaatacaagtgcacagttgtgggtgcgtctgtgtatgtgcgaatacatgcgtctttgtatatgataaaaaccgtgagtgcagccaggtgcggtggctcatgcctgtaatcccaacactttgggaggccaaggcgcgtggctcacctgaggtcaggagttggagactggcctggccaacatggtgaaaccccgtctactaaaaatacaaaaattagccaggcgtgatggtgcacacctgtaatcccagctacttgggaggctgaggcaagagaatcactggaacctgggaggtggaacttgcagtgagccaagatcatgccattgccctccagcctgggtgacagagcgagactccgtctcaaaaaaaaaaaaaaaatccatgagttaattccagtacttgcaattttaatccaatagcacagttttcttttgcattgttttcaatatactcaattgctcagccctagaatacacaaaaagtagttttaagaatgctaacctggcccactgtggagacgatgcctcctaactggagtgtaacatttgtctgtagttcttgtcatttgtagcctgaggccgtggagtccagattttgggttcagaagttactggaattcactatcccatcccattggtcagaccatgtcactcatttcaaatacagtttggttcattttttctgatttcattccattctaggattctcctcccatccttgttggtttatcttcttttttgagacgaagtctcgctctgtcgcccaggctggagtgcagtggtgcgacgtcagctcacggcattctccgcctcccaggttcaagcaattctcctgcctcagcctcctgcgtagctgggattacaggcgcctgccaccatgcccagctagtttttgtatttttattagagacagggttttactatgttagacagcctggtctcgaactcctgccatcatgatccgcctgcctcggcctcccaaagtgctgggattacaagcatgagccaccacgccccgcctatgttccttttttttagaaacgtgaaacctgaacttggttccaaaagtcacaacaaaaaggaaaactcctggccgggcggtggctcacgcctataatcccagcacttcgggaggccgaggcgggtggatcacctgaggtcaggagtttgacaccagcctgaccaacatggtgaaacccgtctctcctaaaaatacaaaaacttagctgggtgtggtggtgcacgcctgtaatcccagctgctcgggaggctgaggcaggagaattgcttcaacccaggaagcagaggttgcagtgagctgagatcgcgccactgcactccagcctgcgtgacagactatctcaaaaaaaaagtaaaactcggccgggcgcggtggctcacgcctgtaatcccagcactttgggaggccgaggcgggcggatcacaaggtcaggagatcaagacaatcctggccaacatgatgaaaccccatctttattaaaagtacaaaaaaaaattagccgggcgtagtggcgtacgcccgtaatcccagctactcgggaggctgaggcaggagaatcgcttgaacccgggaggcagaggttgcagtgagccaggattgtgccactgcactccagcctggtgacagagcaggactccatctcaaaaaaaaaaaaaaaaaagtaaaactcaagagtagggtgtcccttcctctcctccctgttgccctggctgaaccatctcccctgtcttgtttgtcacagatcccagcatggtgagtgcctacatgtacccagcaggggccactggggcgcaggcggccccccaggcccaggccggacccaccgccagccccgcttactcatcctaccagcctactcccacagcgggctaccaggtacacaggaaggccgctcctctccttccagggccagccccagccccagccccagccccagccccttctcccatggcactcattccctccgcagaacgtggcctcccaggccccacagagcctcccggccatctctcagcctccgcagtccagcaccatgggctacatggggagccagtcagtctccatgggctaccagccttacaacatgcaggtacagtgacctccaggccctgctgggggccagggtgggggagcagttgatgatgctgagggtcctttggtgaggctggcaggcactgggtgggctccaccccttctgctcctccccctccactctctgggtgctccctgtggtcacctttggattgttgcaagccagaaacatccccgcctgcctggtcacagggctactctctcacatctgacgtcttctcacaacagaatctcatgaccaccctcccaagccaggatgcgtctctgccaccccagcagccctacatcgcggggcagcagcccatgtaccagcaggtgagccattcccggggcctcacagcggcacccgcagggcaccctcaggcttcacggtttagcaatgggacccctggccccagtggggattgtcccgtacgtctgctcacagggggagacgcatacccgaggccccttctcagcagacagaacgaggacacaagtctcagggcagatacgcgcatccgcaagtgtagacaggaaaaaccgtgaatttacttgaaaggcaaaggccgcatgagctggctgcatgagctgcagtccgtggacatggattacaagcacttgtgggtctgtggctctgctgggacaaaagccttcctccctgggctggggaagggaggaccagggccatgcctgctttcctcctgcacagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 666 - DNA, 8782 bp, Homo sapiens
caatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgaggccggggcccgggacgcggggcggatgggaccctggcgccgccgagacgcctgcaaaggcagcagcccggccccacgcacccggggatcgccgcgcccggggctccctcctggagagcgcgaggaggcccccgacgcccggatggccgatcccgggtggccctccagtggtggccgccgagctcgaggcctgcagggcgcagccgcgctccccagcttcccagccggcttcccagttctcggcaggtggcgatccagccccagctctacactttaatacctggtgaccttgggggagtcacttggcctctctgagccacccacccccatacattcaagaacgctccttccgcctagttagaagttgtggggggagttctgtgaggtgcacaggtgttggcatctagagacgtgctggctgtagcatacccagggtgtgggccaagccgccccccacccaggggtgtttagcacaccgccggacgtgtccctgggcaagtggggtgacccgatgccccggctttgggctgcttccttcggagagctgcgtgggcactggaagcgatgttaggaccagcacacccccaggagagatgccaggagaccctgcacgcgtgtggtcctggccctatgaaagcgggcgtttctcagcacgagaagcagccaccgtttttttactttttttttttttttaatgcttatggggcaaaataagacagagctctccttgtttcccagggacagccaaggggcgttgttttctgaccgtgtcttgccacagagaacaaagaagaaagggcctgaggctttgcacagtctgcccagcaggccctgccctgtgaacctggctgtggtcactgggcagccgcctgtctaggggacctttattttagcagcctgtccaggggacttgtattccagcagcctttgaggggactggctttactaatgagcaacaatgctggtcgctgcgtgaaggccaggtgagcagatgtgggcgtcttggggcacctgagacctcactggtcctgggagaggccttcagagctcccaggccacaggcagccacggccagtgagatgcagccacagcgacaggaaggcgctggcatgggcagaagaagcgagcccctccttggcatcgggctcttcctttcctcctgggcgccgcacaggtgcccctcccccagggcctctcccacgttcatctgggtgttgaaggcgggacctgcgtgctgctgtcccttgtccggggtctgagccccactgccccttggccctccccaaccaggcgctctctggctgcagaacaccgcctgggggaggcgggactgccctctggcctgggagggcgggaggagccagctgctggcagcatatggcgctgtggtcagggtgtgctcctgaggactgctcaccaggcctctctgcctggccgtcggaaagatcttttaaagcttcttgagcactttgtcccatgtccctacagtccctaccgtcgcatctggccgggacgggggctgctacctgtgtggcccagtccctctgttctgctgggctcgcacaatgggaggcccctctctgtccccacccatctttgccgacccctgggcgtgcgttacggggccgcgcacgtgcaggtcacactgagcggcggaaggacttctttggggtcagtgctgggggtgggacccaggagctgggatcctgggccaggtgctggccttcctgtctggccctggccaatccccctactgccgggagctctcagctggccaggcgaggaggcagaggtcctgtgagtggtggaggccaacagaatgggaggttgtcgggctgacagcccccgagtgcctgcccacagctcctaggtgctttgcagaggaggccgctatgccctgccgccagccacaccgtccccttgtctgctgctgagctcctgctgcctttcaaggccttctatggctacctcctcagtctcccatggtcctgcaggctccctcgccgtttctgagcggccataaacgtttgtccctcttgagacgtggtgtggtggataaaaagtagggctctggggtctcctcgctgggcccaaatcctgatggcaccagcgggtgcgttacctctccatgcctcagtttcctcatctgcagaaggagaatggcgagcccctgcggccagtgcagccaatactcaggtggtacgcggggcgctcgcggggctcgcggacactctcagctccatgtccactggtgtggttgctgttggaaagcagtggtgtgagctggttccaggcacgggtgtggagtccccgggcagggccgtgggaggccttatcactgcctcctgcctcagtttccccctctctggatgaacctggcaccgatccctcggggtcgctgtggggtctgagagcactcactcccgcaggtgcatctgcagacgcagcaggaggtgaagctgcgcatgacgggcatggcgctgcgggtggtgcgtaccgacggcatcctggcactctacagcggcctgagcgcctcgctgtgcagacaggtgcgtggtgtgtgccagccttgggctcccagactggggctgagtcctgcagtggcatccaagctacttccgtccccttttcaagactttgtgcaaggaaggacccaccaggccgagagctggtgaccccagggtgcgcctcccatgggcacccacccagtttgcagggctgggcctgagaccgccacttactggtggggaagctgaggcccagggagtgagaaagcagggtgcagctctagatttgtgaactggctcagccgcatgctggcacagtggccttgggaaggcccctcagggtccctgtggcccctcgggctgagggggatccctggctgggccgggtggcgaggctgaggggtgtggggcgtgcccgtccctccaagccaggcccttctcccccagatgacctactccctgactcggttcgccatctacgagactgtgcgggaccgtgtggccaagggcagccaggggcctctccccttccacgagaaggtgttgctgggctccgtcagcggtgagctgccgggcgggagggggaggggcgcggggtggtcaggtcggccgaggacgccgtgtgtcagcacggctcatctctggggtttgtgtcaccgcaggtttagctggaggcttcgtggggacgcccgcagacttggtcaacgtcaggttggtgttcccccaccccacctgcaaggccaggggctttcttgtccccagacatgccagggcctgccagggctgcttgcagggtggggtcagcctggaataagccactgagaccctggtgtcctgggcataggagggtgggtgtccctgagccccggcgtgccctgtcctgtgggccccgctgaccagcgtgagctcccctgtgctgccagggctgcccatgcccctcggcccgcccgcccctcccgccacctgcttctgtttcaggatgcagaacgacgtgaagctgccccagggtcagcggcgcaagtgagtcatgggcggccttctcggggtggttgaggtgcaggaggctcgggcgggagcggacccctggctgctctgccgtgacccagctgaggctccagcaggccgaggtgcctgcacggtccatggagggtcctgacggctgttctggactcgggggtgtcactctgcgcccccaggacctttgggttcttcctgtggggagagccttgttggattgggggctgggcctgtttgcaccccagggtggtgagtgcggaggcgaacgccccaggcatggagagagcgcatgcaacagaaacgcccgaaggaggcgctgcctccctgcccagctcagggcagctgtgccctcctgccacggcctggggtctttccagggcccggggtccgctccaactgcagtgtgagccacttcccccgccccttccaaggacccctggggagttctggcttctagctgtgcacacagactgtgttcccccaggaccccgggggctggcgggcaggaggcctgcatgctaggagcggtgcccagccagggactctgttggaaacgatggaacctcctccctgagggccgggcggggcgggcgaggtggctgtgggacgtcaggaccagcttcatgttcccagggagagatcttcaggcccatgaggcctctgcttcctcgagaacccccggcctgcctcggggcctgggaggaccctctgtgggagccggtggtcagggggagtctcatgtggtcattctgtgtccccggcagctacgcccatgcgctggatggcctgtaccgcgtagctcgtgaaggtgaggggcaggtgctgtgcacaggcagggttctggggggcaggcagggtgggcagcgctgtagaagactgggcgctgagggatttgggccaggtgcctggcctcaccccttgcctcaccccttgcctcaccccttccttgtgcagagggtctcaggagactgttctcgggtgcaaccatggcatccagccgaggggccttagtcactgtgggccaggtaggcctcctgcgtggggtgggtgtgggcagtgcctgtgaccactgacctccatcttcagaggggccatagaacaaggcactgggcgccaaaaccctcctggggagccaccagctgtgaccttgtggggcagggtggggggcacgggtgggtcagggctgcagcctgtgaaggacctcgggcaggtgcctcccctgtctgggcctcacggacggacagacggagcaggtgcttggccattgccaggtggtgtcgcctggggccctgtgtgctttccccaagctggggtcccccctacagccctgaccgcccttgtgcccctgcagctgtcctgctacgaccaggccaagcagctggtccttagcaccgggtacctctctgacaacatcttcactcactttgtcgccagctttattgcagtaagtggccggcatggctagggtgggcgtccctgggccggccttgggcgctgagggcacccaggatggggcgagggctgggggaggcgggggccttgggcatctggcagtgccccctggggctcataagtggggtgccagggctttgggagctcatgggtcagcctggtgcccccgccagcatgttcctggcccgccctaggagtcaggtggaggttctggcacgtgggtgggattcggcgatggtgcctggcgtacctgacaggccgctggtgacgagccccctcctcagggtggatgtgccacgttcctgtgccagcccctggatgtgctgaagactcgcctgatgaactccaagggggagtatcaggtgagtggggccctgcctgtgcagttgggctgcacagcccagcgagtcccctcacctctccggggggtggacactcgcactggggacccggggaagggtgtccctcccttctagttgcctgtctctgcacagcacttgccttgggagagggttgtgcctttgaatgcctttgccttgtttttgtttttagagaagacttcttggcccggcgcagtggctcatgcctgtaaccccagcactttgggagcctgaggcaggcagactgcttgagtctaggagttcaagaccagcctgggcaacatactgaaaccctgtctctaccaaaattacaaaaattaggggccaggtgcggtggctcatgcctatcatcccagcactttgggaggtcgaggcaagcagatcacctgaggtcaggagttcaagaccagcctggccaacatggtgaaaccccctctctactaaaaatacaaaaaattggctgggtgtggtggcgtgcgcctgtaatcccagctactcgggaggctgaggcaggagaatcgcttgaacctgggaggcggaggttgcagtgagccgagatcacaccattgcaccccagcctgggccacaagagtgaaactgtctcaaaaaaacaaaacaaaacaaaattggtcaggcttggtggtgcatgcctgtagttccagctacacaggaggctgaggtgggataatcccttgagcccaggatgtccaggccacagtgagccgagattgcaccactgcattccagcctgggtgacagagtgagactgtcttaaaacatttcttttcggccaggcacggtggctcacgcctgtaatcccaacactttgggaggccaaggcgggcagatcacaagtcaggagttggagaccagcctgaccaacatggtgaaaccccgtctctactaaaaatgcaaaaaaattagctgggcctggtggcgcacgcctgtaatcccagctactcaggaggctgaggcaggagaattgcttgaattcaggaggcggaggttgcagtgagccgagattgcaccactgcactccagcctggatgacagagcgagactctgtcttaaaaaaacaaaaaacaaaaaaaaacacatttcttttctttcttttttttttcccctcattgcaacctccacctcctgggatcaagcgattctcctgcctcagcctcccaagtagctgggattacaggcgcccgccaccatgcccggctaatttttcatatttttagtagagacagggtttcaccatgtcggccaggctggtcttgaactcctgacctcaggtgatccgcttgcctcggcctcccaaagtgctgggattacaggcacgtgccaccactcctggctaatttttgtatttttagtagagacaaggtttcgccatgttcgccaggctggtcttgaactcctggcctgaagtgatctgccgcctcagcctcccaaagtgctgggattacaggtgtgagtcactgtgcccggccaaaaacatttctttcacagattaacagaggtggtgccgttcatggcagtctgtgcctcataggtgctctgggtctcctgtcttgggcccccgccaactccatggggcttccacgtttgcagagcccatagctctgtcccttttcttctccctgacgctgccgtgctgcatccctgattctcatggttctgttcacagccccctctgcccactggaccccgggctgcaccctcgggccctggttgtaccgcatgagcaggcagggtggccgttgacctggctggtgcctgcagacctgtggtcacctgttaccagccagcagccgccgctcacacccacacccacacccacaccccacattgagaatgcccaggccaccgtgcctggctggtgcctgggaggggattttcgttgccttttgggtgagaagcagcctttttgattgtttcactgcgttttctgcagggcgttttccactgcgccgtggagacagcgaagctcgggcctctggccttttacaaggtgcagtggtggcggcagtggcggcttgggcaatggggagcgggccccttcgggctctgtgtctctcattttccctgtctccctccagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgccacatc

SEQ ID NO: 667 - DNA, 1554 bp, Homo sapiens
ctcctgtgaaaccaccatagagaatttatttttttctcaggtgaagtcagtaactaattcttcctattcccgttggacacaaggagtctgtgagggggtgtgaaggaaggaggctgcggctgcgtcctggactccgtcctgcggtagggagtccagcagggatggctcagcctccgcacctggtgtgcagccggatctccatcctgaggaaggccttgaggttctcatcagccacgtgctcctccagggcagccagggcccgctccccaccgtcctggaagtgctgcagcagcctgtccgcgtactccacccacacgcagttggggcagccactcatgcagcagtttgtgggcggctggagctcaggtggcagcgatgccttgggcggcctggtgccgtccgcacctgcttgggagcccacctctacgtggtctgtcccgaattttctgcgcccatcaggggcttgcgctccgggatggtgcctttgaagaaagctgccacctccaggaagcctctggcagcagtccgggctggagaaccggcgagccccctgaggatgcagacaaacatgtgactctccaggaagctggtgaggcccggtctacccccagcagtgaggacatttcagctctcctgtcattgggcaactggctccatgtcctcagctttttcacttcctgtgactttagacatgttatttcacctctctagactcagtttccccactgtgcaatggaagtcatgggtatgacacggtgtgattcacaagaagtgccaggatcagggcctggcgccgggtgtgcactcaagcacatggtggggggtgggggaggcactcgacacctccagctaagatggctgctctgtggacaccagtatgcgagaggtgtaaccctgtaagctcctggccagcccagcacctctaccagtataaccaagccccaccacctctgagggaccaaccggaagaatcgcaccaccctttatccaagtttccctgtcacaaagcccaggcctctcaggcccctctcatcccagcgtgaatgtcctataggcagtcttccgtcgctgccctgctctatctacccaggatcacggactgacacgctaccaacttcacttatttaactagtcctgcgaggggcatcatccgctccatgtccacggccagtccccagagcccaggagggctcgcacacaggcgctcggcagatactgagaaacaggaaagtggccgttcaccgggctgcttcctctcccaaggctaagcggcccctccacagattccggggcggggactcggtaagagccgatggaggagaggagcgaggggtccttcggcggcggccagcgcgcgatcctcccggctccgtccccacatgcgggtggaggggccggggctcctcccggtacgtgcgggcccccggacagcggcctctcggacgtgcccttcggcgctgccaagacccgtcctggtacttgccgagccacggaccgcggcggctaccgcccggcctccctcgaccaccctccgcagcagcatcgcccgcggac

SEQ ID NO: 668 - DNA, 7177 bp, Homo sapiens
cggaagtggcttcgctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcaggtgactgcgctgccccgcgaggccgccacacttccccagagaaggggacgccttgaaggctccgcccgggaccccctagggagcgttcgctcggaccccttccccaggtcgggctcagtgccctcctctgtctgtgcccgcggcccacgctccgccaggatcggttgaatgaatggaggcgcgagcgagtccttggttttgcctttcccgcgtcccagtgtcccgtctttgtggttctggacgaggtcagggcggaaaggcctcctgggctttcggagtgcctttcggcctcgcgtcccgtgaggaaggggttcagggacagccactgagtgagaccgagaggaaagatccctgctccctggactgctggaccggctcgcaccacagaagccagatgtggcccctgtatagatagattctttttttttttttttttttgagacggagtctcactctgtcgcccaggctggagtgtggagtgcagtggcgcgatctcggctcactgcaagctccgcctcccgggttcacgccattctcctgcctcagcctcccgagtagctgggactacaggcgcccgccaccacgcccggcaaattttttgtatttttagtagagacggggtttcactgtgttagtcaggatggtctcgatctcctgacctcgtgatccgcccatctcggcctcccaaagtgcagggattacaggcgtgagccaccaagcccggccagcccgtgtagattctattgccagacccaactattgtttctcttactgattctgcttgtgctttacttgggacgggtctcacccccgtgttctttctcccagcaaagagaagaagaaagtgaactgcaagcccaagaaccaggacgaacaggagattcctttccggctccgggagattatgaggagccgccaagagatgaaaaacccgatcagtaacaagaagaggaagaaagcaggtgtgtgcaggcccatactgggcggcagtgaagctttgtgtgtctcaacccgcccaatcgcccaaatacttcagaacgtttcaggcagaggaaatatgccaagacccggtgctcagaaggtgggggagcgtggccaaagctaaagcagtggctggcagctggtggcgctgtggttccagacgaggcttggaaggaggctgtggggtgggcggggaggacccgttatggggcctcaggatccatgctaaggagcggcgtttttttctccccaaaagtagcgaagattcatcagagtttttagcagggcacggccaattcatgtttactctaagcaaaaaaagggtcaccgagcgatgatggagtgagggagagtggacctggcaactggcggggctactgccagggagaagccatgattcttgggacaagagtgctgaagcaatggtagagagaagtgggtggagtcaggagctgaaggaggaaattccatcaggcccctctgagaagtcttgccttcctcccccaagtctgggtagggtgtccacatgtccaccgctgcaacccagaggtaacactctgggcatgttgggaaacggagtccactgtgtgtatattttgcttatagacacatttctcttcccaaacgtggcactggttttacagcaaagctgttttataatttgtgtataaactgtaggcttcttgttgggggttatatggctgccaaagggatagtgagatagaggtgaggaaggtgcagggaggaggcgcactggcctgggtagcacatggcacgttctgaaccgtgctgcattgaattggcacctttgtttgtttgtttatttatttatttattgagatggagtcttgcttcctcgcccaggctggagtgcagtggcgtgatctgggctcactgcaacctccacctcctgggtttaagcagttctcctgcctcagccgcctgagtagctgggattacaggtaacgcaccaccatacccagctaattttttgtgtgtggtttttttttttttttttgagacagtctccctctagcccaggctagagtgcagtggcacaatctcagctcactgctacctctgcctcccctgtcccagttccagtgcaagcaattctcctgcctcagcctcccgagtagctgagattacaggcacacgccaccaagcccagctaatttttgtattgttagtagagacgaggtttcaccatgttggccaggctggttttgaactcctgacctcaagtgatttccccacctcagcctcccaaagtgctgggattacaggtgtgagccactgtgcctggcctttttttttttggagacagaatatcggctcactgcaacctccaccttccaggttcaagcaagtcttgtgcctcagcccccccagtagctgggattacaggcctgtgccaccatgcccggctcgtttttgtatttttagtaaaggctgggttttgccatgttggccagtctggtttcgaactctggcctcaggtgatccgcccacctcagcctcccaaagtgctgggattacaggtgtgaaccaccatgcctggcaatatgcatgtcttcacatatttatgaacacaaccacctgcctggcactgtccgcctcctgtgttctacactcgcccggggtcctgcgcttgcgttctcagtggatgtcataggtctgcccacgtttcttttttgagatggagtctcgctcagtcgcccaggctggagtgcagtggcgcaatctcggctcactgcaagctccgcctcccgggttcacgccattctcctgcctcagcctcccgagtagttgggactacaggcgcccaccaccatgcccagttaattttttctgtgtttttagtagagacagggtttcaccgtgttagccaggatggtctgaatctcctgaccttgtgatctgcccatcttggcctcccaaagtgctgggattacaggcatgagccaccgcgcccggcaggtctgcccacgtttctctgtgtagctccactgggcttctttcggcagctgtgcaatggagtctgtgggtgatcagaggagaattcattcaaccagccacctaggggtggacattaggttgtttctgctttcctttttcagctgtgctgcagtggacatctgtgacaggtgccattgggctggggggtcacgtccccggggatgccgggccgggcattctacatcctcttcagctgctgtcgttggggtgcttccagccagcctggtcttcccttcctgtggctttgggaggggaaatgagcatgggtcacctgcctgccactgtctgcctcctgcctcctctgaggcctccctttgtcctcagcccaggtgaccttcagaaagacattggagaaggaagcaaagggagaggagcccgacatcgcagtccccaagttcaaacagaggaagggggagtctgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgtgagtggaggcgggagggggaggggtctgccctgggagccggagggaagacattgggttcccatgacggccctctgcaggtaccctgtttcatagccatggggcagcctggattcagggagaccaagccagagccctgggagttggcgagtcggagcatccagctgggagccagtgagggtgtggcctccaggaggctgcggaacctgggaactctgcggagacctcgcttggtccttgctttcacaggaaaagcaccagaaagccctagccctgtgggaatcagccctgagggggtcggtctgagggtgacgtgcccaggggttctgtttccattagaacagaatgtctctcgtccaagagactacaccttcctaattctctaaaagctttggccgagtacagtggctcacgcctgtaatcccagcactttgggaggctgaggcaggtggatcacgaggtcaggagatcgagaccatcctagccaacacggtgaaaccttgtctctaataaaatacaaaaaaaaaaattagccgggcgtggtggtgcatgcctgtaattccagatacttgggagcctgaggcagtggaatcgcttgaatccgggaggcagaggttgcagtgagctgagatcgtgccgctgcactccagcctggtgacagagcgagactccatctcaaaaaaaagaaaaaaaaaaaaaagctttgaaggtttgagaggttgctttcagctctgtagattccctgtttctggattgttgtattacttatagttaccttagccagtgaaagttcatcacagagaacgtggcccagatacagcctggcgccacggtgatctccagagctgtcgctgaaggtgaagcttccagattcacattgagggagacgtgatatacaatgcttgttaggccctttagacacagcagcaccggatgggctggatgagtctctgttgggtggtctttggcagccttcccagccttcgtgcacaaggtgccagtagcccttgcccacgtgtctgcacacattgtcagatgttccctggcaggtagctgtccccagctgagaaccactgggggacctgtgaggggcctgttggggtcagagccttctttggtgggcagctgtgggttttggggtggtaaggggagcggggacttggaggcagccacctgttcttgggtccctgctctgccacaggggatcccttgtgggtggggcggcctctgcctcctccctgggtggaaagagaatttaggaatctgagtgacatgtgctttcttccccaggttccagaagcggcgactagataaagtccgacggaaaaaggaggaaaaggcggcagacaggctggagcaggagttgctccgaggtagctcttcccaaagcgatggtgtcagcagtggtccgggtggggcctgggcgcaggccttctgttccccaccagccctggctgcactgggcacctgtggtttcccctggggtccacagccattagaccactggatgagttggtgttctgtcccagccctatgggagggaggtgggcgggtggtggctctgggtgtcaggggtgcagtggctgtgggcagcagtcctcagttgtattctgctcctccagacacggtgaagtttggtgaggttgtcctgcagcccccagagctgactgccaggccccagaggagcgtaagcaaggaccaggtaagtggggcacggggacaacttgagtttgtcccccagtgctgccagggaacagaagccttggacaggctggacacggtgggtcacacctgtaatcccagcacattgggaggccaaggcaggcggattgcttgagcccaggagttgataccagcctggacaacatagcgagatcctgtgtcaagaaaaaaaaaaaccctcagccaacgtgtgcgctgtctggtgtgtggcctgagagtgcagtgttctcgctggcgggagagctgttgaagctgtgaggctttctgttgcatcccctcctttcccagcctgtgcctcaccctcccctctctccctcagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaaataccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaa

SEQ ID NO: 669 - DNA, 6120 bp, Homo sapiens
aggcaaggacacactaattttattttgaaatagggactgcaagggcaggctgtattgagaaggatggccccctggtgtgatgagcttggggcctcatctgctcaccgtgcacgccctggagtcctgctacccagcatgtccaaactaagggcacccccctgggaagggatgcagagacggggagcttctctgtatccccttacaggcaggacagggggctggggtgcagaagcactctggggagacctgccctagctttccagctgggaggaggggacgatctggggtccagcaggctcccgggctggggtccacttcccgttctccctgggagtggagaccgaccaagcctctctgtgggcaggactgaggggtgggcctgtatctccagatgttgagcagggcctggccagcccctgagggggcatcctagagggaggtggtgggctcctggtgactggtattaatatgtagggggagacctgaggttgcagtcccatcctggtgtccaggtgccatctgggctagggaggcatctcctcaacaggaatcctgagcagggtttagagcacagtgggcaggagggggagggtctggacttcagcagggcctcgtgctagatgatgccatattgggccagctcgtgcagctccaggtggttgaaggcctcccaagggcagatgactgtgatgtctgtgggagaaacgggccacggatcagagaggatcccacggcctagggacccccccatcccctgtggccctgtttcccacagcccaggtgtagccctacagtgtgctgagcggggacgtgcggacgctggagtggggccctcctctggggacacactggctgtgggggaaggagggtgggtgcagcaggtccaggggagggaaccagaggagggtggggcttgctgaagggggaggaggcagcgaggggttctgttctttcccaaacccctcccctcacctggtgcaagtgtcccaaatggggacagccccaccctctagatccagtggatctggagctcagtgttgggggaagaagtgatggacaggctgggggtccctaagtgaaaagcaggggaggtgggggccgaggtgggctgcaatgggccccgggcgtgctgggtgtgcctggggggacctgggcagacctcgggttggtactggcagccgtcatacctgttcccaggccttccattccagggatgtcgtccccaaacctgcaaggacagagcactcagggacatggccgggcccagtcctggctcagtcagcctgaggcccgaggtcatctctagccttcctaggagatgaggtgtttggctgggagcccagtgggcagagacccgcctcctccccaacctcccagggcttggcgcatctgaggaggcttccctcacagacccagggtgagtctgctgcccagagcatcatggggctgaggcctagaaaaggaggtgcaagtcccaggatgctgggcaggtgcgtgccctgggggagtacgggggggtgcgtggttggtgcatggtctgagtgtagatttgtgaaggtggcttgtctgtgagtgtgcctcacgtgcatatgtggaggtgtgagcgtgtttgtgcataagagtgtcatgcccgtgtgtgcgcacacgtgtgagtggacactcctcggtgcgttgatgggagcgcggtgcctgtgtgcgcacacgagtgagtggacactcctcggtgcactgatgggagcgagatgcccgtgtgtgcgcatgtgtgagtggacactcctcggtgcattgtgccatggctgtccctgggtggcagtggttgtattttttttatttatttgagacggagtctcactctgtcgcccaggctggagtgcagtggcgtgatctcggctcaccgcaagctctgcctcccgggttcacaccattctcctgcctcagcctcccgagtagctgggactacaggcgcccgccaccacgcccggctaattttttgtattttttagtagagacagggtttcaccttcttagccagaatggtctcgatctcctgacctcgtgatccgcccgcctcggcctcccaaagtgctgggattacaggcatgagccaccgcccccggccgttttgtttttttgagacggagttttgttcttcttgttgcccagcctggagtgcaatggcgcgatctcagctcaccacaacctctgcctcctggattcaagcgattctcctgcctcagcctcctgagtagctgggattacaggcgtgcaccaccacgcctggctaaatttgtatttttagtagagacaggtttctccatgtttgtcaggctggtctcaaactcgcgatcctagggggctactttggcaggtattaaaacttttttttaggccgggcgcgacctcaggtgatctgcccacctcagcctcccaaagcgctgagccaccgcgcctggccggcagtggctgtattttcaagcatggttggcagtagcatctggagcgggtgacaggagcccccaattccccttccccctcctccatccctgctcaggccctcaggcaccgccctaccttccccagctgtgaggctgggaccactcacccagtgaagtggccccaggctctgccccgccctccccttcctgtgcagcctcaggaccgcctcctccctttcagaggccccatcccccagctctgcttacccttgaacgcctttctttgggggcttgctcttgaactgcctggtctgtcgctgcttaaatttagggggccctttcctgggggtgacaggtcccccggccaccctggtggctgaccggaactcagccttgggcggttccaggttcatggtgaggctgacggagacaccgcggcaaccttggctcctggactccctcctgctgcggtctgggggcagaccaggcccgggtcccagtcagccctcctgcttccaacccttgtgggggtctcaacccaccggtggaggggctgagacccagccccgccagctccagcgtcatccagacagcagcccctgcaatccgccctggggtaaccagcctgccagctttgcttgggtccacccgcacgctcccattccccttgcctagtggatgcccccctgcaacgctggccacacacagctccggactcccccctgtcctggcctccctcgccccggcccacaatccacagcaaacctagcctcccaacctgtggcaggtcctgagcctggagtcctcaccacctccctgtgggtgaccactgacaacttcctgccccttcccctgcgttccccaccccagggaagcgtgactcccgtcggcatttaactgctactctgggtttttttttgttttgttttgtttttgagacagagttttgctcttgttgcctgggctggagtgcagtggcactatctcggctcactgcaacctccgcctcccgggttcaagtgattctcctgcctcagcctccccagcagctgggattaccggcgtctgccaccatgcccggctaatctttgcatttttgcatttttagtagagacggggtttcaccatgttgacgaggttgtctcgaactcctgacctcatgatccacccgcctcagcctcccaaagtgctggtattacaggcgtgagccaccgcacccggcccagctgctactctgatgaaagtcctctgtggctcctgctgggaatgggcctgccaggcccagcagaggagcctgcctctgagctgcccttcctgatggttagtgggctgcctccatctcaagttcccgctcagggaggtctcccctgaacccccgccctgcagccactgtgtccttaggttctgatttgccgcttctcatcacgcgtcgagttagccctgattccaggctggtgggcgtctcccgggctgttgccctctgattcttttttttttttttttttgagacagagtcttgctctgtcacccaggttggagtgcagtggcgagatcttggctcactgcaacttctgcctcccgggttcaagtaattctcctgcctcagcctccggagtagctcagattacaggcatgcgccaccacacccagctaatttttctttgtgtttttagtacagatggggtttcaccatcttggtcaggctggtctcaaactcctgaccttgtgatccacccgcctcggcctcccaaagtgcagggattacaggcgtgagccaccgcgcccggcctaaaaaagttttaatacctgccaaagtagccccctaggatcctattccagagctgtggctggaatctcaccttttttttttttttagacggagtctcgctctgttgcccaggctagagtgcagtggcacgatctcagctcactgcaagctccacctcctgggttcacgtcattctcctgcctcagcctccccagtagctgggactacaggcgcccgacaccacgcccggctaatttatttttttttttgtattttttagtagagatggagtttcaccatgttagccaggatggtctcgatctcctgacctcgtgatccacccaccttggcctcccaaagtgctgggattacaggcgtgagccactgcgcccggccaacccctctgattcttattgatgggtttattgctttctgcctcttgtctgtgctttgcagttggggtgctgtcagttcccttcacccactcacggaggcatccctgagcccctcagcaccatgacgggcaccccgcagtgctgatggagaatgacccacaaaatggggggcagggtccccaggcacggcgcccctgggaaaggggcctgtctcagagacttggtgctgagctgtgaagccctgcgttccccaaccccacttcatagagggacaagctggggcttggggacggagggtgccgggcatgtgttccccctgctgggggaatcaccaggccctctctgtgtctggagtcagctcggggagcagggtcacccgcctggcgtggcgtggcgtggctgaagggcctcggccgctctggacgagatcagtgtccctgcactgctgcacagggtggcctctcctcctcctctccctacagcctctccccagatgccctaagccccagtgacctgggccaagggcagttcagcttcccctaagcctattaacagcagaggggaattcctaatctcccatcgagctgctgtcagctgcacatgctgccggaaagttctggaaggaggcacatgacacagacaggaggggctgcttgcccgcactggatgccccagggaccacctcttggggtcccctttcctgcccctggtctttttggctgggattcctgactccagccctgggctactaccagctgtttgccgagcttcaggcgtgagagtgatcagaaagcaagggcaggtggcccattttggggacgcgggctctgcaaggggtgctgggcacctgggattggggtggaccctgccatggcaccttccctcactaaggttcagcctctgtccccgggactgggaccagcaccagcctgtgcaaaaccagcactcaggagcccggtggtcccagctgctcagatcccatggcacccaatcctcatatcctagatagcacaggccccgtccagctgcttctccagccctgggacatgggctgtcctgggcagctctgggccctgatggagctccaaccatcagatgccatccatgtggaaaccgctgcctgcgctgccctggcccgacccagcctgtgactggcgtccactcaggtcagctgagcccacgtggcctgaggttcccagaccatcactggcctggggatggtggaagcactggttaccatgggggagcagaggaggaggttggctgggagtcccctctgaataacagggtggcgggtaggcatctgcagacccagacctcagccacggtggtaaaagcctgtcagctccctctgccccttgggtgatgagcagacccccactgactcactgggggaagtggctgccaggaaagacagcggggttggccactactcaccaagtgcagggcgggtctcagggggctgtgctgtgagtgctgggcctccctccgcagggtgccagccccggcctttatctcgctg

SEQ ID NO: 670 - DNA, 6120 bp, Homo sapiens; identical to SEQ ID NO: 669

SEQ ID NO: 671 - DNA, 8782 bp, Homo sapiens; identical to SEQ ID NO: 666

SEQ ID NO: 672 - DNA, 8782 bp, Homo sapiens; identical to SEQ ID NO: 666

SEQ ID NO: 673 - DNA, 6432 bp, Homo sapiens
cagtcaggaccagcccagcagcccagccacagaggagccagcgaacctctcccggcgcctgtgctgggggctttctgttccagcgtcaaggatggaggagggggagaggagccccttactgtcccaggtgagccatgccaagtggccttgccctgaggttggagatgtccccagccctgaagtcctaagggaagtccctgggctgggttcacacccacccctgcccctggtgccaccccacacctcaatgctgagattgggttgaggggggtggttctaggcagccccctcccccttccccactgcgcagttctctcagccccatgctggcctctggtcaagggatctgccagatctccctgagggccttgggggcaatctttggctcagggtgcaggagggggtgaaggcaaatgtcccttgcagccagcctccaacggcctctggcccccagtggccccagtctggccaaccaggcactgacagcctgtccttttgcttctagtgacttgttgaggtcttgggggtgataaataaccctcctctggggccgggcacagtggctcactcctgtaatcccagcactttgggaggctgaggagggaagattgcgtgagcccaggagttcaagaccagcctgggcaatgtagcgagaccctgtctctacaaaatattatatatatatatatatatatatatatttagatagagtctcgctctgtcaccaggctggagtgcagtggcacaacctcggctcactgcaacctccgcctcctcggttcaagcaattcacatgcctcagcctgctgagtagctgggattacaggcacatgccaccacacccagctaattttttttagtcgagacagggttttaccatgttggctaggatggtctcgatctcctgacctcgtgatccacccgcctcggcctcccaaagtgctgggattacaggcatgagccaccgtgcccggcctacaaaaaataattttaaaaaattaccgggacggccgggcgcggtggctcacgcctgtaatcccagcactttgggaggccgaggcgggcggatcacgaggttaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaattaccaggacatggttgcagtgcctgtagtcccagctactcaggaggctgaggaggaaggatggcttgagcccaggagtttgaggctgcagtgagctgagagcctgatgctgtgatcagcttcttcctggtgaaactggattggaatgggatccttgcccagcacacagccatggctgctttttattatttatttagtttttgagatggagtctcgctctgtcacccaggctggagtgcagtcacgcgatctctgctcatgcaacctctgcctcctgctcatgcaacctccacctcctgggttcaagcgattctcctgcctcagcctcccaagtagctgggattacaggtgtgtgccaccacgcccggctaattttttttttttttttttttttagtagagatgaggtttctccacgttgctcaggctggtctcgaattcccgacctcaggtgatccacccacctcagcctcccaaagtgctgggatgacaggcgtgagccacaacgtccagcccggccatagcttcttattctcctttttaaaaaaactcttcccggcagaactgggcacctgcggggctgcctcttcccccacagagagagaccagcaagcctttcctgccagtgggccagggggtcccctctgaaggccctgcagcctccaggcggtcttcctgggctcttgggcaccctcctccctgtcctgggagcctgttgggcagggcactgtcctgtcctcggcagcagggtccagtgccgtgtccacactcagtgcgggccgttggtggggccgaagaatgggtgctgggatgtgaggactggtttcagaggggaaagaaaagggcagccatgtgggccagcccctgtggctggtgaggaagcccctctacacaagttccatgctgcaggcacacacagactgatccacgcagatgctgtttcaaactctggggacgcagccccgcctgtgtgctgcgggaaagccagggcgaccctgacccggggaggccgcagacacccacgcataggaccaggagggagtgggtgtgttcactgagcaccgccctgcttggtcttcaccacagcctttcagagtctgctcatcaccctgttctaaaggtggggtcccaccagagctgggaccctcactgccccttctgctgctcagccgagcgggacggccctgagggccccctgcccctggctgtccgcatctctgagctccagtgctgccctccgccatccggcatcctcccatccctcgaaggctctgccaccatgctcttccctgacccctcaccagttgtcacagagtctgggtgaatgcggtctcaccctgttcctcttccctctgcaggaaactgcaggccagaagcccctctctgtgcacaggccacccacctcaggctgcctaggtccagtgcccagggaggaccaggcggaggcctggggctgcagctgctgtcccccggagaccaagcaccaggccttgagtggcacccccaagaaaggaccagccccttccctctccccagggagcagctgcgtcaagtatctgatcttcctctccaacttccccttctccctgctggggctgctggccctggccatcgggctctggggcctggctgtcaaggggtctctgggaagtgatctgggggggcccctgcccgcagaccccatgctggggctggcactgggagggctggtggtcagcgcagtgagcctggctggctacctgggcgccctctgtgagaacacctgcctgttacgtggcttctctgggggcatccttgccttcctggtgcttgaggccgtggcgggggccctggtggtggccctctggggcccgctgcaagacagcctggagcacaccctgcgtgtggccatcgcccactaccaggacgacccagacctgcgcttcctcctcgaccaagtccagctcgggctgaggtgctgcggagctgcctcctaccaggactggcagcagaacctgtgagtcttggagtgggcgagggacagggccaccacagggtcgcagaggccacacacccttgtgcgtgtacacacagtcactcacacgtacatactcattcgtgcatgcccacatgcatgcacacgtatacccacatgtacacgcatatccacactggcacgtctcgtgctcacaggtttcacgtgtgtggacacacacctacacactcctctacactgacatgaacatgttcttgtgcacacacaaaacagcctcacactcaggcacacactcacactcaaacatgttcatacacacacgtgtcatgcacacaaggtataggggtgcttgcctctccttgttctatgggctcagggccccaatcagccctgcggcccccagaacgtgcagggtgactctgttccccccgccagggccaggaggactacccaggagcttagttgagaagctgagcccacaaacttagaaagtcatttttctgctgggcacgatggctcacacctgtaatcccagcactttgggaggctgaggtaggcggatcacctgaagtcaggagttcaagaccagcctggccaacatggtgaaaccccatctctactaaaaatacaaaaattagccaggcatggtggcaggcacctgtaatcccagctactcaggaggccgaggcaggagaatgacttgaatccaggaggtggaggttgcagccaaaacagcaccactgcattccagcatgggcaacagagcgagcatccatctcaaagaaaaaaggccgggcgcggtagctcacgcctgtaatcctagcactttgggaggccgaggcgggcggatcacgaggtcaggagatcaagaccattctggctaacacgatgaaaccccgtctctactaaaaaatagaaaaaattagctgggtgtggtggcgggcgcctatagtcccagctactcaggaggctgaggcaggagaatggcgtgaacccaggaggcggagcttgcagtgagccgagatcgccccactgcactccagcctgggcgatggagggagactctgtctcaaaaaaaaaaaagaaaagaaaatgacttttaggtgaattcaggacattattctggaatctgactccacagtttccctccaccgtgagtgtcattaaacgccgtgcatttaggatccagtgcaggattttcttatattctgctcaagggtagctgtctttttgttggtttgtttgtttgtttttttgagacggagtctccctctcgcccaggctggagtgcagtggctcgatctcggctcactgtaaagagggtagctgtctgttttatcagctatccccagtgcatgcacaccccaagcagcacctactctccatgccacacccaggacagacgatatgcactctgtctcccaagccttcttggtgcatgtatccaggagcagctgaacacaagagatgaagtcataggcaaccctgaaaactggccattgggacccagcagtggctaacaggcgggtccttccagactctgcaaagcaccacataggttggtttttggccacgtgtgactgggttggtggcagtccccctagagtgtcgtgatgccacgtctgctgctggcctcgtccccatcccctgcctaagtggggcatactcttctagagtggagagggcatggggatgagcctgcaggtctgctgggcccgtgtgcagagccccagacatcagtggatgcctagggcacctggggactgcctgacctgggctgtgatgagatcaacactccctagctaccctgggagctcctcccccacccctgctttctgtcactgccaggtactgcctctcaagcccttgctcttcccagtaagacctgtggaccattccagaagcctctgccagagttccatccaccctcccctgctccaactctaccttctcaatgagctcagcagcctctgcggagggaggtcctcttatcaatgcttgtctgttcccccttcaaccgtctcactaaatatcctcctgctagtcaacacagccaccacccctacctgcaagcgcagaggactgccgtgcacagggatacgttatagagagccaggtgctgtgtgtgtccgtgtgtgcaggtgtgtgcgaataggagggcgtatgcacgtgtgtgcatgtgcctgtgtggccatggaagggtgaaggtgggtaggcgacattcgcctctgtgcctggtcccagaagagcgggccctccccgccagaactgacgattccatgcgccttgcaggtactttaactaactgcagctcccccggggtgcaggcctgcagccttcccgcctcctgctgcatcgacccccgcgaagatggagcctctgtcaacgaccagtgcggcttcggggtcctgcgcctggatgcggacgcagctcagagagtggtgtacctggagggctgcggcccgccgctccggcggtggctgcgcgcgaacctggctgcctcgggcggctacgcaatcgcggtggtgctgctgcagggcgcggagctcctgctggccgcccggctactcggggccctcgctgcccgcaggggggcggcgtacggccccggagcgcgcggggaggaccgcgctggcccccagagccccagccccggcgccccgcccgctgccaagcccgcccggggctgagcgcacgccccgaggtccgagaccgccacgcacagggatacagggggcgcctccgcccggctaaaaagcgcggcctgcgccgccgccgccgcctgatttcgctcgggcttcgggtgacttcgccgcaggacctacccagctcgctcacttcgctcgctccgcgtcccccatgccagcccccaacgcagggcgcccggcgaagccacgggactggcgggaggagcacgcggggccggaggaaatcctgaagctgaccctcacctccgagcccccactcccaccccagccgcacagttcccacctcctggcacctccctcccctggggccgccaccccttctgggctcgtgatggtggagctaaggtccaggcctctccctcccgagtgcatttttggggagatagtaaatgttttattcgggtgtatcattcatacagtaaagacaccaatcttca

SEQ ID NO: 674 - DNA, 2732 bp, Homo sapiens
tttatttttttatttcttatattttttaagacggagtttcactcttgttgcccaggtgcagtgcaatggcatgatctcgactcactgcaacctccacctcccaggttcaagggattctcctgtctcagcctcccaagtagctgagattacaggcatgcaccagcacacccagctaattttgtatttttagtagagacagggtttctccatgttggtcaggctagtctcgaactcccgacctcaggtgatacacccgcctcggcctctcaaagtgctgggattacaggtgtgagccaccatgcctagcccctggggacacttttttcagaggccagatgtcaacttccatctccacatgcctcagtttacacatcattgcatctcagcacagagccccatcatgtagggttactttgggttattctgcccctgtgagaagaaactattggcagcaaagccatactgccctctgccacctctccccagctcaggccagctgcgcctctgccgtgcagtcaatcgttggctctgtgggtggcctggagccaggccagcacccctgctaagccagtgccttcacgggcgctgatttctgccgtggtgatgttctgcttggcacaagcaatgatgtctggaagcctgattaatgacttcatctcctccgtggacatgtaacagggtaggtcgctggagagaaagaggtgccccatcagagcagtggcagccacacacctgccccggacccccagctgcaccacctccctaccgagccatgcttccggctgtaacccgagggagcccccgcccccgctgtgctccctctcagctcagggacgcgtacattttattgaagagtatcagcaccgatgcttctgcaagttgttctgcagaaaggagacctaagagctgcacacaggatgcagagagctgggtggggtcagaggcgtccatcacaaactggggaaaaagaaaaagacagcagcaatgccccgctgccaaacttcctcccctgggcctcacagacctggcactgggagagcaaaactgcattttttaattaattaatttattttttgagacgaagtctcgctccgagtgcagtggcacgatctcggctcactgaaactccgcctccagggttcagggttcaagtgattctcctgcctcagcctcccaagtaactgggactacagacacccgccaccacgcctggctaattttttgtacttttagtagagacggggtttcaccatgttagtcaggatggtctccatctcctgacctcgtgattcgcccacctcagcttcccaaagtgctgggattacaggagtaagccaccgcgcccggcccaaagtagctttaaacaaagctttgggaacaagcagaagcagagggaatcgagttttatgaagacgacctggtgtcactcgtctctgtcctcatgtggccatcagttctccatactggtatccgcggcacaggccttatcaagatgagaccaaccagaggtacgtataagtccaacataaacacagacgtaccggggagtgacacagagggccaagtctgttctctgcggagcagcagccctgccctcagcaagccctctgtgagctcctaccgggggcctgggagcgcaagcaccagaaaccagacagggtgcccagcaggaagcaacactagctaagacctatttccatgagtagtatagtcactaaataacccaaacccctttctacacacagcaaggttggggactggacgtcacagaaatgtagacacacttccctaaaggaagcccatataggattacaacccaccaggagagaacggcagtttccatagtaactggaccagatggggcccatgcaccccccaagctcccggatggtgatctttctctgtgccacgatgtcagtaagattggtgcccacctataggaaaaaccacgatgcaaaaagaacaatacaaccgctgtcccgttgtgaactcctgaagagcaccgtgcccacaccttacacggtggcctgaaccccgcagacccattctccctaacgcaggaacggcgagcagggaccgacgcccatcagtagctggactcgctgtgggggcgaccagccacaggaagccgttgcgaggggagaggaagtgcccgtggagggcggcaggccccctcatcccgcgccaattatcctcagctcgggccgtcccccgctcccgaaggctggccttaagtcacgacctgacccgctgcgcctcggcgtgcacttagaggagcccggagctcttcgccaagcgcagaactgaccccccgcaactccacccgcgggggcggacacctaccgtgggccgtgtcgggggcggctcccccaggtcgcctttcccatcccgggagctcacctgtgcgaagcggtcaaggacccgagcagctaaagggtgagtccccgccccactccgggtgccccccgcgccccggtcccgtccccgcgcggaaggatatcctgcagccgtttcaccagcagcgtcttcccgacgcccgtggcccccagcaggagacacattccgtgcttcgctccacccggcacccgtagctcggcgccgcggctcaaggcccgcccaccggccactctcattggatagttctcaccttcggacttctcattggttcttagggctcattgttccaagggcgcgtccaattagcgcgcagcgttagcgggagagcggaagac

SEQ ID NO: 675 - DNA, 4158 bp, Homo sapiens
catttccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggtacgcgggatcctggggcggtccgggccggcaggcgggttagggggcagccgggcactgaggggtcgatccgggcgaggagggcggcggggccggcctccctgcagcggccaggccgggcttgggggtcccatcgggggcgcggggaggaggcctcccggtgcgcacgccccttccctcctgggccgtggaaagcgccggggtcggccccagatgaccttggacgattccctgctcctcccttggcctcagccttttccgcagcaaaggcccatccgtgggtgcggcgttttgcggccaggggcccccatgttttgggaggctttgcgcaggaagatgcacctaagtaatagtttcgccaccgctgggttgatgtagttcattcaaaccagaaacttgaggtttgagtggtatggctgcaaataaacacgtggctttctaaggctctttgaagaatttaaagtaacttgcaaatcttatcaatacggaccccttgaggtctgagaaccctggactgggaccaaggagctaggtaatttccggccctagtgattaccagcctgagcttatggcacccaccagtcccccagttgtcctgcccctctggtttctgcagccccttccattccaggactgacaagtctgttttaattgggggtgggggctaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaaggtatcgtgagagggtggcacagacccaggggctggaagtttcagggcccctgtgttttgttcctggtgtattttgggagtttggtaaattgtcaaaagtgtgtttgtccaggtgcaaggtccatgccaggctagttgcccctcctcagtaggttccggctggtgtgagggccagctgtggacactgttctctatctctgcagaaaacgttgaagatccaggatgtcgggcttgtgccgatgggtggtgtgatgtctggggctgtccctgctgcagcagcccaggaggtgagtcctgggcagaatgaggcatttctggggtgcccagttcgcctgtggcctcatgtgccgtggtcccgtatctcaggttctgcagctaccgtcattgtctgcagcctgcacacctgtgcggcatcctgcagcctcctgggacctactccctgccacggatgtgcacgactttgcatgtggagaccatgtttctaatggagggaaacagacactaagctgagagaggaaaaagaggctgggcgtggtggctcacgcctgtaatcccagcgcttcgggaggccgagacgggtggatcacttgaggtcaggagttcgaggccagcctggccaacatggtaaaaccccgtctctactaaaaatacaaaaaaaaaaaaattagctgggcctggtggcacatgcctgtaatcccagctactcgggaggctgaggcaggagaatagcttgaacccgggagactgtctcaaacaaacaaacaaaataaataaataaaaataaaaataaataaataaataaaaatacaaaaattagccggcgtggtggcaggtgcctgtaatcccagctacttgggaggctgaggcaagagaattgcttgaaccagggaggcggaggttgcagtgagccaagatcatactactgccttccaacttggcaacagagcaagaccctgtctcaaaaaaaaaaaaaaaaaaaaaagaggaaaaagaaaggaagaaattataccaaatagaacattgtaagcattgtggggaaaaggagggaagaggctcaaggtgggagggagagttccaagttcaaggtgggcttcaaagaggaggcagacattgtagaagagagcacggccttcctggcggaggacggggaggcaccaaggtcaccaggcaagagggtgtctgacaattcagggagcagcagcgaggtacaggctggcgcaggcgaaggggtgtaacaagcagctccgtccttgggtctttgcaaggaaaccagtgaacttgaagccgccagttgcgtttggtcatcgggttgcgtgaacctctccaccggagccctcccctcagcccctttcccccactggggaaccaggttgtgtactgtagagtgtcccatgttccagatgcgtggggtgcccatggggcagcatcactcatgcctgagaactggaaggtagtttaaaggctgattagattcaggccgagcgtttgggtaagaatagctgggattactgtagagcctgttgtgtaaactggattgcttttgaggagggagaagatgttattaatagccttcccaggccgtggggacacgcagccccctgccctcgggtggtgctgggtctccatgcgccacgtcagaagcgcagcgtgcccgtcagtcccatggcgggttgtcattttctcggcacacgtgcactgcagtgtggctgagaaaggaatggcgctgcttttatctacaaagcacttttggtgtcgttctttcctgtctcataagttacgctttctaagcgagaggggagtagagtattgagggaaggactgtgaagcatgtttttatttatttatgaaaccgagtctcactctgtcacccaggctggagtgcaatggcgcgatctcagcccccgcctcccgggttcaagcaattctcatgccgcagcctcccgagtagctgggattacaggcgcgcaccactagagacagggtttcaccatattggtcaggctggtttcaaacttgacctcaagtgatccacccgccttggcctcccaaagcgctaggatgacaggcgtgagccaccggagccaccactcccgtccgaggcatgttacaaagagttattgggcagacctgcctctgactagcatgagagaaaaagcaccagctggactcgcgaggccaaggcaggagaatcgcttgaacccaggaggtggaggttgcagtgagctgaggtcgcaccactgcactccagcctggatgacagagtgagactccgtctcaaaaaaaagagaaaagaaaagaaaaagcaccagctggttaaggattgatgagttgggagacgtgacttccaactccaggcttcgctggggcctccgctgcacctccctttggggctttagactggggtggcccagcagtggaggcgttagctccccccagccctttgtcacctggctccccttctttcctgctccctaaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggtctgtgccgcggtgggggttccgaggcaggttccgttgtggtggccagggcccccagtccctgactttgctctctctggcaggcaaagaagctggtggagtccctgccccaggaaatcaaagccaatgtcgccaaagctgaggcggagaagatcaaggcggccctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcagtgtgtgga

SEQ ID NO: 676 - DNA, 8565 bp, Homo sapiens
ctcggagtgaggggtgctggaggactggcagccaggccacgaggggaacgggacctggaaatccccaagcctgggtatgagaaggcagccgagtgtgcggcggcagggcaaggttggcctgggccgcccagaggtcttcagacccaggggcgaagctggccacgacccagccccgcggtgaagccgcgcctagccttggtgctccctgggggaagtgcagggccacggctggcccggttcccagtgtcctcccccagcccttcgctccccaactcgagagccaaatctgtgagggcatgggctggagcccctggctgccttcctcttgcccccatcccttctggccaggccaagtccgagggtgcaggggcaaggaggagagttgggggcctgagccctggctccagaggcccagagcatgcctccccagagctgaaggtgggagatgggtaggttctccctccgccgttgggtgtgactccggaactggcttgggctctggcctccaatgctgctacggggccaggcccacctccgggcccaggcagcagcactgcagggcctttctaccctccccaagcctggggcccaggcagcccctgtccagcaccaatctgtctatggggaactggctggtccctctgctcaggggaccccgcagtccagggttctgagtgggagcattggcaccaccccactcctgaaagcgggggcctggcaggatgaggatggcctgtgccccccacaccttggcccctggctcggagagcagggtgacaggctgccttcctgggctgtggagagcctcgcgtgcacctcgcctccagctcctgtgctgggtcgtgaggtcgacctcacaacagcagaggacaggcccatggggtgccacatgggccaggtgctgtagggcagaggccattctggagaggaatgtggggctgaaaaaagtactgatcataagcctcattttgaatgcggcgagaccaggcaatctatggcctccctagacacctcccggaggctgcagtaagaacctcttcggcctctgggctgctccaggcgggccgtgacaggggtgtgggagacagagatcccatggcccctggaggggccaaggggcaaggagcctcagctctggctctcctccttattctagcatcgcctgctacagggggtggccccaggctttggagggctggaggcccgggtttcactcactgccaggctgcccgctgcactcccggctgctgggtgcatggtgggggcagggccaagagggtctccttgctgagtggttccctggtccttcccagcagggctgggagccccgcgcagcactgccaccaggctttattcggttgtaccaaagagatttccgtcagccatgtacaaacagaacagagtccataaggagagtggcgaagctgccgggaaggaaggcaagcgtgttttcctggagccaggcgctgggtggcaggacaccgtgttggggggtgcccagtgggaggtggtgtggtctacacccagagaactaaaggggtgaccgcagtcactgctccctaaagccctctgctctgcacctcccgccacagctgggtgggcagtcagtgtggcctctgtccaggtggtgggggcatccggggaccaggtgggggcgcacgcaggagcggtgcgtttcaggctgcaggtgccgtctgcccgtctcacttccggcctctccactgtgctggacaccctctctgagcagctttgctggaaagagcggagagcctgctgcaaaccaggcaccttgtaggcaggcaaggaggcagagtcctcaccagcccttccagagccaggccagttagagagggcagccctgcagagtcctatgtccaaacgcagaaggcgcagaagcagagcagggggagggccggccagggcctctgccaggttagaagtcaccatcgcgctcccccaggggctgtgccgcctgctgcctggcagcctccaggaaggccagctccttggcttccttcttctggtttcgcgcctcatactccaacctgagagggcagggtaagtctagcagagagcgcccatgaggcggctccgagggggagggcagggtaagtctagcggagagcgcccatgaggcggctccgaggtgcccccacccaactgcacctgttggtgatgatccgctggacgatgaggtctgtggtgaggttgctgccactgtcaatctgacggaagatgccccttctcttgggctcctgggggtccagagaggaggagcgggatgaaggtccctgctgacctccccaagacccatctgatgccctgccccagagggagaccagcgcccagggtcccatgggagtggtgcagtcggagcagctgcgccaccatgcccgtttcccaggcaggcacagtgagtcattaaatggctgggaggtgccaatggcaacccctgtgcccagcaagggccagcatgacccacctggtatgggtcggagccatccctgtcagggataatttctgtcttgccgtgacacaccaggtccacctggagaaggagtggggtcaggagccctccccggggaggcagcggccgtcgccacccacagcccagcacaggccccgggggttgggagagctgaccctgccctttcctcagcccaggtacctcctgggccccgcctaggagcccacagccagcctgcattcccagcccatgcaggaacagaggtgaacagagggaacgaggtgagcccatgcggagcctcaccttgaagtgacttaggagctctgctgtgaccgcgtacggggctccaatcaccacttctgacacgtactgtggggacagtgggggcagaaagacttgctcggtccctgctactggtaagccagggccacagggtggtgagagacggctcagacatggggcggggctgccagtgagtagcagggatgggctgggcaggctggggacccctggggctcctccatgagacaagaaggaacagcatctggagacctgaccacccctcctcatgcctcaacaaacaggtatgggcaggtgccacagaactcggggtgctgggtgcagctctgccagtgacccaagcccccctgccctggctcagggaggcccttagtaggggggatgttgtgggaatgtctccccatccttgggctggctcctggcccccactcacccggcaggccagcacgctcagagtccgttcatgcagattcatgatggggtagttcttccccttgtagtgattgacctcctgcggccagagtgcggctagctcagcccggagactttttggggggacagggtgtgcccctcccggctgtccctcatgggaagaagtcggggaggttgctcgcccttgtggggatgccccagacaggacagccctggaccccagaagcctacgatcaccccccagggtctcctgtgacttcacctggggccccttcccagagaccacctgcacctaacagcaacgcttagggcccctcgagggcccatcagctgcccaggggcccagggagcaagaaggcagtgacctggtcaaagtgtaagcccgcgatgatgtagggcctctctgccagcctgtgcaccttctccaggaagtccacatgcccgatgtctgcacccaggttaagaagcagtcgggatggggatgacagggagcagctccctgacagctcatgcccaagggcctccccgccatcctccctgctgacagctgctcccctgcaaaccagccagcccagtctgggggccccaaggagtcaagtgaggcccccgggtcccaccccatgtggcacatgtaggggagcagcagaggcccagaggatacggaacaggtcgaaggcaccagccacatagatgactgtctcccctggctggggctccttcccagaagcaaactggatgatcttctgagatgtctgcaggaactgggataccccggtccaggggttccgcccaccagggcactgcaagccaagagagggagcaggttggcgggggaggcctcccaggtgctgccctcaccaggtcaccaaaccctcagctgtcacctgccagcaatcccatttccagccagtcatctcgggcaggggacacactgccaggccaggtggcaggtgggactgtggcgccaccccacaaccacagcaggcaccgcagcagacaccacttcagcccagcaagcgaccaccaggaggaggcaaggagccctgtggcaggtgcacacagcccttgggagggacctggtaccctgagaccactgtctggtcacctgggagcagccttctgaggaaagtatgtccccggcgggtatcgggtgagggggctacaatgggagagagggccaggccacttggttagaggccacctgtccacaggcaaatccttgctcctccaagcagtggctgccgtgaccggccagccggtgccaccacccgcctgccctccctcccagcatccaccagtgagccaaacctggcagtcagtgcctggtcagtgccagggacagagggaggagggtgaggctctgggctggcctttccccaagggatggctgggacaggtggccgggggagccccctgcagctgcgtgctcagctctccctgcacagccgcactcaccttgccaaaactgtctgcatactcccggtactcagaggacatctcctgcacagaaggtcagagcagggctgaggggcctgccctcccggcgtggccaccccagaaccggctggggatggggagcagtgggcaggaggaccctgagagggcagggaggtgcccctcctttcccctggagacctcgacccaggggcctcggggattccgccgccgactcacctggctgctgtgatgggctttggttaccagcagcatgcggcccacgaggtctgtggtggacaccccttgcgtgcgcttgcattctctgggggacacagtgggagtggggtctcatcctgggacactcgcaaggctctgcctcctgctaccaccactagggacactagcagccctgctgtggcagaacccacggctgccccaaagactgagggtccccttcctgtgcaaggccataacagaaaacctgggttgggaacatggggaaggcctccacgcttttattgactgaagggagtggcaggagcacagaaaaggacccttgctggggcccaggtgtgcaatgccagggagaggatgggcactggggtagcagctctgcttcctgcctccctcacacccacgtcctgcccgctgagcatctgcagctgagtgaattctcagctgcagcatctcatgcgggagccactggcctcatgtccctgacgtctggtaattcagatatagtgccagctccccagcagtgccagccacgtcccccgagctcaacagctgccacctcacaaagctgtgcctttggagccctggggccatgggtctgcagcaccaaatggcaagggcctccaggccaccccacaatggcacctccatccctcgagttcccagtcctgggcgtgaggaacatggcccagggcctggacgctcccctcacgggctcccggtaaatagcaaagcacgagccaggagggagccccgtgtccagctccctggatggccaggcccgcggtggagactcacctgtacctcccagcctgctttacttcctcataggtgtcccggccatctacagtcagggtgatgtcatctaagcagtgacacacaaggacaaggatccttaacccaaagccaccagaaccttcagagcccaggaccctctcggcccctggcctgccctagtgtccgcgtgcccatttctaggtgggggcccggaaatgtctcagatcctcaaagggcggaggccccctgttcccggatgtcccaccagcagatctgatcctgagccacctgatgtccccaggcccccaggtcccagccccgccactcactgccgtgaacacagaagtcacagttgtatttgtccagggtctctagtgtagtgacgtagggagccgctggcaccacctcgtccacccatttgatggcctgcaccatcttgtatctctcctcctgagtgaacaccgggggccccttgtgcttggcgatctcctctaggaaaaggacaacggggagactggggaccccagcccacccggcccctccagtaggaggccccttcccagcacccagctgtagccacacaagagggccggtgggggcaggctgtctctctaccctggcccttagcccactagtgctggccaactgggtggctctcttccctgcgagggtctcaggcaaaggcagagattccttctgacgagcaggtgctcagcccctgaaggcttgggagcctcgctggcagtggtggggagcaggtgccccttctctttagctgggacaggaaatgcaagatgggaaaggcattaggccatcctcagctggggctgggctgggtgagcctacagtgccctcccctacagctgtgccctggcaaggtggccccaggcctgcaggctttcagtcaacagtcgcaacccacaggagggctggggggccgcgggtgggcgaggccatctgtgcttaccatcggtgtgcacgcctacgatgaggtagtcacccatggcccgtgcctggcgcagctggttggagtggccgtaatgcaccatgtcatagctgtggagacagagagagtgggtggtccctgtgccaagggtggggaccaggtgtccctgtgggttaggggcagagctttgctcctctgaggactccttaggaagcgctctgagaagctgctgctgggagccctgggactgggattcggaggatgtaggtgctcagctctccaccccactggctcctgggcctgacggtgggacccctgtgccagatctagaaagggtggcaggggcagagatgtcaaggcctggctgggtctagaggactggtgggtgcaggacagactggagcccactgaaagctgcagggccacgtgtcctatcccctcaccaaatatcaactgccctgggcagtcactttaaaataagccgatgttaactcttggggtagggttggatcctagactaccttgagacaagcaaacagtccctggggctaacccaaaacaaatccaaccacaaaataaaaccctgggaatcactggccctgaaaatcctgtctctcctcccttacggcctcaagctcagcaggcttaacgctaagggtgaacagccactgccttgccacctggctcgagagttttcattcacaaatctaggtctgctaacacgtgaactctcaagcccaaagctacacagccctgccaccaactgggcctcgctgccctggcttcttcgccacttctttacagcagcggcccatcccctcaagtggacaaagctgtccctgcctctccagggagaggtgtgaccctggcagcccacacagtgcacagagttgctccactgcacaccactgcttcctcccagcacccctgccacagtgcgcggagcccggcagacatgctgggtaaaatctggcgggcccatgtacccactggacaggctggaggggaggagggggcagaggctgggccaggggagcacagtctggaatggggctggggcctggtcagggcaaggtcaaagtccactgacacaaagccacattccttttcccagaggtgactcggacacagaagacaaggccctgcttgctctcctgggaagggctaatcagatagaggcgcttgcttcctggattccatccggcaggcacgtgaaagggtcagaggtagcaaattatcagtaacggtcgtcttcctttcacttgttgacaacccgaaacttttcttaaaacaatgccctctgactggccagggaagaccgatcgcattctagccccgcggaggaggacccgggagcccgcgggcttcaccgcgggtcccggacaggcaggtcgcacccgatgcccacctacagggacgctcgcccggaggccaggggaacccctggaccggagccgggcaagctggttgctggtggttacggagaagcagggaggccgtggctccagatctcagcgcggtggctgcaccggagaggtcggcgtgaccgggcggggcctccgccagaggtagacggggtcgcccacggcagggcgcggagcctctgcagcccgaccctcccggcaggcgagccccgcagcctgccagccccggcccatgccggacgaggacgccacccagaacgcgggcccggtccccgggcaacggctggcgcggcgccccggaaggaagccggccccggcgcccccgcggcccgccccggccccgcgctcaccagccatcgcaccacaccctcacggcgcgcctgccccccgggcccggctgctctgcgccgcctgcagccccgcgcccgttccggatcatggccccgcagcggcggcgcggacagcctggcagctcccggcgactccgagcgccgccgcccgccccgccaggcgcacgctcagcggccgtcacgcgggcctcacccgct

SEQ ID NO: 677 - DNA, 17512 bp, Homo sapiens
gacaggtggtaaaatttcaactttatttggccaatgtgttcaattcgattgtgaaatagaaatgcctgaagaactgtcagcgtctgattcagctccagcatccttggccacctccccacccgggagtcaagggtcgtggttctgccttgaacaggccacaggccgtgctgtagagaggccagtggtcacaatgagcccacgacaggaggaggagccctggcttgagggaaggggaaggcccaggcctgtgccgggccccagggctggcagccaccagctcctcttccaggcatgggggacaccctgacaggatccggaagtctccatttacccaaaaatgcaagagccatgatcagtcatggcgacactgcaggcggtactgagtgaccatgtccagtccggctccgtccctcccacacgggggacaagcttctccgaggaggcctggccaaggtggaacaaataccctgatgtcgaaaaatgtctaaaaatcccacagacggaattttcaaaaagaggagaaacctcccgcgggagggaggcagcgagactccgaacacggtagcaagcactctggacagactcatgtatgaaaaagtacatcatggtttcaggaaacaagccccaccagggtgggctgcctggagatggatccctttccaaaaaccgaaaagcagaaggaagagacgggggtgaacggacggtgtgtaggggtgaggtgtcacttcagagaggttccctgggtttccggcgacgccctccttcaagcgaggccgcaggcttcggaggcgtgcgctgctgctgggtgtgcagcccccgaggggtctcggcagcgcccgggtctggctttgcgtattacagttcatctttcacagctttctgatcatcgtcttcctccatgtctggctcctctgcttcttccaggtcctcgagatcctgggatacaggaaaaggggcggggcgggcaggttggctgcaacagctgaggctgccggcccccagcaccccacactgctcacaccggggactagccggccacggcggacatggccaccggccactggagcagccaaccctggtctttacgagctacacaggggtcttcccaggaagagtgacgcctgggggatttctgcctatagcaggatgaatcagagcccccactgtgtcaggaaccctgggaatcccagctcagccttggacccttccactgggcatggaaggcgtatgtgtgtctcccagcttggcaccatggagtctacagagggtccacatctcggcagggacaacagccccagcatgaagtccaggcacagtcaccactggggtgtgaccattctacttccaacccttgggctctggccaatgacaggccacaggcagcaccaggggccggccctccatccccagcctgggcagagtattcccacctcccactgtgcaccagcactcccagcaggccctgccagcctgggctgaccatgccctcatctccttcaccatggtcaagcaccccgcccctgccgcatcctcccaacaccagccttcctgcttccccggcagagtcaccactgctgctggccacgcgctgacgggcaggactaaactcccgagggcagacccatgtctgcgcccttgtgcccgggccccgccagcgggctggggatggacctctgagtccaagttagcagcatgtgaggaaccggtgccatgtgtctgaaaaggttttctaagcaaaatctggtttttaaagatgccttcaacgtcgtcccctaaagaagtgctggccagggagagctgtttcagcagagcactgggagcacatcccttgccctgctgggcgaaggtgtggagccccagagccctggacgcacagacgtgcctccaatggcaccattcccatcacaagccgagcccaagtgggcatgtcccgtggggccaaggggctgaatcccagagaccagcccagggctgtgaccccactcacgtcatcatcccctgccccatcctggccaccgctctccaggaatttcttaaaaccatccagcgtgcgttccccgttgtaatcaatgacctgtggaagacagggatgagtgcaggggctggtcccggcccagagccaatctcctggcattggctcctcctccctagagaaaggcagagcaggcccggtccggtggctcacacccggaatccagcacattgggagttcaaaaacagcctaggcaatatagtgagatcccatctctctcgaaaaacaaaggtgggtgcttctgaaggagctcccacagctcttctcccacctgactagccccaggctccttccagagaggcacccaggctggcgtggggaccactgctcttcccagagcccgccccagccccgtctggagggaaggcgcaccgtcctgtcggcactggcaggaaagaacttgagtgtggggaagctgtgcactttgacggcctccacctcgttggcagtcgagtccatcttggcgatgacgatgttctcatggtccttgtacgtctctcccagtttatcccaaatgggagccaactgtttgcagtgaccacaccatggggcatctgaaaagaaagcagttctagggtgtgtcctggacacaaagccactggcagacgcttccccaggagtctgcctaccttgcgcgtgccctggtggcacggacctggggagctgaaagggcaacacttacagaactccacaaagacgttttttttctcatcaaaagccacgtcttcaaagttcttcccaacaagcaccttgacaggctgcttgtcccagtcctccggcagctcctggctcatcaggtggggctggagggcaggcagggcacggtgaggggcggcgatgcctgggggaccacagagctccccaaccctcaccctgcccgggactgaggtgcgtggctgccctgggcacaccagggtggcagccgcagacaccaacagtgccaagaatccagaaagagaaggctgggccagtgggctgggcccaatgagcccacgcaggccgcaccctcgccggccaggaggtttccctgaggagcatctgggccagccgtgtggacaagagggctcctacaggtccccaaaggtgtgacaagaatggtggtcttcacaccatcttgggctccgtcctcttactctgaagatcttactttgaggacgaagcccaggacactgagagcccagagaccccaaggtggcggctctacccgggaggcagccctggcccggggacgcgcctgcaccttgattttgccctccaggaagcggtggcagaactctgtgatcctctctgccgtcagctcctccgattcgggcttgtacttggtcatctcctcctccagggtgatgaggcgcacggccgggcactcttccttcttcaggccaaagaactcgaggatgcgctggttgtcggtgtggtcgctgtcgatgaagatgaacaggatctgggggagaaaaggaggttgcacaggtgcgggagacggctggcctctgcctccagccctgactttgctcggaagcagaccgtgctccggtgcctttttcctccaacctggattccggggttgcccaaccagaccagcaggtgactgggagcagaggtctggcctggctggcccctcgcctacatccaggctgtcctgaatcaggtgcccgatccagtccagcaggcagcctcaggaaggccccacacttgtcacctcgggaagagttgtactgctccctggcaccgccccacgagccacccagaagagcagctcaccttgcccttgaagctctcggctgctgttttgaagttgctcagtttgccgtcatagtcagacacactcttgggcaagaacagcaggatgtgagtcttgatttcacctccaaaaatcttcggggctgtctgtgttataaacttaagttactgggtctgagtcacacactattaatgcagaagattctcccaatggcctccaatgtcagacgctggacagcagtggtgaccgggagcctcatgccacccccaacccactcctccccatccccagcctgggggctgcagggcagccgcacctgctcggtgaactcgatgacaaggggcagctggttgtgtttgataaagtccagcaggttctccttggtgacctccccttcaaagttgttccggccttcatcaaactgtggacagaaagagggccctgactgagcattgctgctgggagcacagcccctgggcccgggtctccctggacgtgggaagtcacagcagccagcagccctgccctcccgtggggtttcgagccacaggtccagcaatgggtacaggacatggctgttcctcgacagtaagactggctctggtcacggccttatggctgcccgtgaattcaacagctggcttcacatccacaatgcaagcctggcgcacgtggtcctccagcaaccttgaagtgtggcccatccccagggcccctagccttttcagggcacccatgtggtcaaagctattttcttttttatttgtttttgagacagtctcgctctgttgcccaggctggagtgcagtggcatgatcttggctcactgcaacctctgcctcccaggttcaagtgattttcctgccttagcctcccgagtagctaggactacaggcgcctgccaccatgcctggctaatttttttttgtatttttagtcgagatggggtattaccatgttggccacgaaggtcttgatctttttttttttttttttgtgatggagtcttgctgtgtctcccaggctggagtgcagtggcgtgatctccactcactgcaagctccgcctcccggattcaagccattctcctgcctcagcctcccaagtagctgggactataggcgcccgccaccaccggctaatttttggtatttttagtagagatgggtttcaccacgttagccaggatggtctcaatctccttacctcgtgatctgcccgcctcggcctcccaaagtgctgggattataggcgtgagccaccgcgcccggctggtcaaagctattttcacactcacacttctctggcctctgccttttcactctccctctcacgtgctgcggcacagacccacagaggctgctgggcgcatggtgtcgcaagagcaggagggcaggagaggagaatcctgctggaggaatctaaaacatcactcagcactaaattgtttttgtctgggacaaactagtttccgtaaagatgtgatttatgataacatgtaatgggattattattcttttaaaataaatttggctacagtggctcaggcctgtaagcccagcactttgggaggccaagatgggtggatcgcttgagaccaggagttcgagaccagcctggccaacacggtaaaaccccatctctactaaaaatacaaaaataagctgggcgtggtggcgggcacctgtaatcccaggtacttgggaggctgaggcaggagaatcgcttggacccgggaggcggaggttgcggtgagccgagatcgcaccactgcactccagcctgggcgacaagagcgaaactctgtctcaaaaaaaaaaaaaaaaaaaaaaaaaaggccaggtgcagtggctcacacctgtaatcctagcagtttgggaggctgaggcaggtggatcacttgagttcacgagtttgggaccagcctggccaacatggtgaaacctcgactctaccaaaaatacaaaaatttagctgggtgtggtggtgcacacctgtaatcccagctgctcgggagactgaggcagaagaaacacttgaacccgggaggcagaggttgcagtgagccaagatcgtgccactgcactccagcctgggcaacagagcaagactctgtctcaaaaaaaaaaaaaaatacaaaaatacaaaaatcagttgggtatggtggcacctgcctgtaatcccagctacttgggaggctgaggcaggaggattgcttgagtctgggaggtagacattgcagtgagatcgcaccactgcactccagcctgggtgacgagtgaaacaggccaggcgtggtggctcacgcctgtaatcctagtactttgggaggctgaggcgggcggatcacctgaagccaggagtttcagagcagcctaatccaacatggtaaaacgtcgtctttactagaaatacaaaaattagctgggcgtggtggcgggtgcctgtaatcccaactacttgggaggctgaggcaggagaatcgcttgaacccaggaggcggaggttgcagtgagcccagatcgtgccactgcattcgagcctggcaacagagcaagacttcatctcaaaaaataaaaaataaaaataaatagagagaaaaaaacgattttttacattcttagttctagtttctaatacaacagatcctgaaaggcgcaatccacgtgcctgtaaggccctggggacccctaataatgcacggcagcttcagggagtcctaaggccacaagatggagaggctgtggcgccccaaccacgaggggtcagcctgcagctgaggatgcggcctcggctcaggctcagagaggcgcccctgtgctgaggctcttcaagtgagaattttgggtgagccttccatcattcccccgaactacttttttatttatttttaaaatttatttatttttttattttttgagacggagttttgctattgtcacccaggctggagtgcaatggcatgatctcggctcactgcaacctccacctcccgagttccagcaattctctttcctcagcctcccgagtagctgggatcacaggcacccgccaccacgcctggctaatttttgtatttttagtagagacagggttttaccatgttggccaggctggtcttgaactcctgaccccaggtgatccacttgcctcggcctcctaaagtgctgggattataagtgtgagccactgagcccggcccaaactattttattttttttttgagacggagtttcactcttgttgcccaggctagagtgcagtggcaggatcttggctcactgcaacctctgcctcccgggttaaagcaattctcctgcctctgcctcccaagtagctgggattacaggtacgcgccaccacgcctggctaattttgtttttttagtagagatggagtttctttctccatgttggtcaggctggtcttgaactcccgacctcaggtgatcggcctgcttcggcctcccaaagtgctggaattacaggtgtgagccactgcacctggacagaactactttttaaaatacttatttatttaatttattttattttattttatctattttgagactgagttttgctcttgtttccctggctagagtgcaatggcacgatctcgatcttgcctcattgcaatctccgcctcttgggttcaagtaattctcctgcctcagcctcgcaagtagctgggattataggcatgtgccaacacgcctggcaaattttgtatttttattagagatggggtttctccatgttggtcaggctggtctcaagctcctgacttcaggtgatctgcccgccttggcctcccaaagtgctgagattacaggcgtgagccagcgtgtccagccaaaaaaatttattttatttttactttttgtagagacagtcttactatgttgcccaggctggtctcagactcctggcctcaagcaatcctcttgtcctggcctccctaagtgctgggatcacaggtgtgagccaccaagcctggtccccttgaaccttttttttttttgagacagagtcttgctctgtcgcctacgctggagtgcagtggtgcttctcggctcactgcaagctccgcctcctgagttcacgccattctcctgcctcagcctcctgagtagctgggactacaggtgcccgccaccacgcccggctaattttttgtatttttagtagagacggggtttcaccgtgttagccaggatggtctcgatctcctgacctcgtgacccgcccacctcagcctcccaaagtgctgggattacaggcatgagcccctgcacccggcctcctcaaacttcttaaatgagacttggggaaataaatcacgcatcctttcttactggccgtttccatgtatgcgtctgcagagtaacttagagaccaggtgccactccctgctcttgtgcacgctgtgcctgggccaccctggcctggcctgactgccaaggagctgatgttaaaccagggcacaagcaccaaccaccctgcccgaacccgaggggcagaggcttctaagcctgctacctcttccccagaggggcaaaggcgggtaaggagaggcagaaaagccaagttcaggaggcccttggagggaatcctttggaacatgagctgctgatcacagccgtgctcccagtggcacgggtgggctcgcactgtgcccaggagtaacgccgggccgcaactgcaggcaaacgaaatccccccacccctgcagaacaatgtctctgactccctccagagtgtcaggcgccgcctacaccatctcatgccaagaagccaggaggagacactgccgcagctgtcccagggctgccatcgtttcagcagagatgctacaccacactcaatcacggtctactgcggtaagggaaactggtccacttagcagggcacagcagcaggaggccagccctgccaggccacggtgacaaacagcatagaaacgcccaatgcaggccgggtggtatggctcacgcctgtaaccccaatgttttggcaggctgaggcaggaggattgcttgagctcagaagttcgagaccagcctgggcaacacggtgaaaccccatttccacagaagtattaaaaaatagccaggtgcggtggtgcacacctgtggtcccagctactcagcaggctggggtgggaggactgcttgagcccaggaggtcgaagctgcagtgaagtgtgattgtgccaccgcactccagcctggtaacagagcgagaccctttctcaaacaacaataacaggcccagtgctgccagctgggggagaagaaaaagtgaaatatcagaagctctcacacccatggtgccagtgaccagcagcccccgcagaggttttcctgggttgcagtgcctgctagggaaggaagggaagagcaggcaagagcgggccacacaagagcacccgactcagccaggctgcccactgtggccactgcacacacaggaaggcctcactcactttgagggatgggggttaacagcctggtggaaaaggaacaagttggactcatcctctcagctgcggggtgagctctgacttccagggcagcccctaccacgtgcaccggacagggggccgggcttctgcccggagctgcctgcaacgaccacgttcgccatcacagacacctgagccaccttcagtgggcaggaaagcgccacccaccaactggcatcaaacccaagtgggtttgtctgtgcccagctctagtggactccagagaatggagacagaacgttaacctgtggggagcccacatggatggccacgtgtgagcctttgcaggcaagagcaacgaaaccaccctcccagccttcgcggacacatatcaccaaactgtccatagagtcacagcggccactgcagacatccagggcactgaaggagctgtgggctgtgtgacaacacagggttcgcgagtttcgtgggctctggagaaagtctgccccagaacccaagtttcaggacaagacttggaactttctctttaataaaagctctaaaaagacctttggttccttcaactttatccaacacttcactggctttttctagtcagaggtttaatttcctgggcaccttgcaatggcaatagactaatttagcaactctcttcccttcaggggacatcaagagaatgtctcctggtaaagagcatctactgtcttgagttatcttgaggaagtggctgcaaaaacagctaaatgacaagaacaagaacatggaagcaagccatcctgacccacccgcaccaccgcgctccaggaagctggctctaccctccctcctacctggtcccggggagtgctggatgctccgtgcttactacagaaagtgaatgggtcggtggctcacacctgtaatcccagcactttgggaggccaaggcaggcggatcatgaagtcaggagttcgagaccaccctggctaacacggtgaaaccccgtctctactaaaaatacaaaaaaattagctgggtgtggtggcgggtgccctgtagtcccagctactcgggaggctgaggcaggagaatggcgtgaacccgtgaggcggagcttgcagtgagctgagatcgcgccactgcactccagcctgggcgacagagacagactctgtctcaaaaaaagaaaaagaaaaaaaaaaagaaagtgaatgggttccttgtgtccaaaaccactcagccccaatcccagaggctgcccgtctgaccgtttggcttatgatgctgctgtctaaaaggttcttctcccctctggaaacgacacaggacaggagctgaaggtccgatcgcccccggccgccctcctgcccctcactccccaggtccctcctctcccgagactttctctcctatccacactaccctggctctgagcggcacaaacccaccatcacccacatccaggttcagctgtccctagagcacaagtgtgcggccccagccccacctgcctggtgaccgagaaaagagacaatagaaacccacaggccccatcttgacactgtgcaaacaaggaccctgctgtgtcctggtaacggggagaggcggctaagaggccacactgtccaggagcccttccccaggagaaggacagcgggatcaggatggcagttttcacagtggatccttaggggtcataatgcccttggggctgaggggcatacgaagtgtgggtgccacctgggtgggaacacgcccagagcgccaatactccagacctctgggtaaggaaaacgttctggaaatagggatgctgcaggacgctctgaatgtagttaatactttagaatagttaaaacgtggccgggcgcggtggctcacgcctgtgatcccaccattttgggaggctgaggcaggcagaccactcggagctcaggagttcaagaccagcctggacaacacagcaaaaccccatgtctaccaaaaaatacaaaaactcagcccagcgtggtggcacgcgcctgtagttccagctgctcgggaggctgaggttagaggatcacttgagcctgggaagcagaagttgcagtgagctaagaatgcaccaccgcactccagcctgggcggcagagtgagaaaccctatctcaaaaaaaaaaaaggcaaacggggccaggcgcggtggctcacatctgtaatcccagcactttgggaggctgaggtgggtggatcacgaggtcaagagattgataccatcctggccaaaatggtgaaatctcatctctactaaaacaaagattagctgggcatggtagtgcatgcctgtagtcccagctactcgggaggccgaggcaggagaatcacttgaacccaggaggcggagggtgcagtgagccgagatcacgcaactgcactccagcatgggtgacagagcaagactctcccaaaaaaaaaaaaagggcaaatgttgttacatgttttatcataattgaaaaaaaaaaaaaagctaacagtcaaaagcagttctgaggcggctgtggcaggagagtggccagaaggcccacagctgaatgcgaagaccaggccacaggcatcagcgcaacaccccaacttggcaaagctgcagaacatacctattgggccaaaggtgccaggagcaaggttcccttaacgataaggagagcaacgccaccctctgcagaccaaccccagaactaacctgggcagagctgcctggggccactcaccttcttaaagaggacaaccccatctttgtcgagctggtatttggagaacacgtcactgttggaagtgatcccaaatggtatgtcatcgatggcctctgctgcctgcaaaaactgcttggcagagtccgactccacgtcctgaatgaggagggagaagcagaggtcgtcatgatcccgcagcaccaagcagtagggcagaccctgtagagcccaggccaggggggacacgtgcagaactgccagctgcaggctgtggacccctcctcaatggatgacggaaggaaggaagactggaatgctctggtctctaccttgaagaagccgatgacagccacctcgctggactccaccaaggactctgcagctgcgccgtcaggcagggtggtggcagccgggcccgtgcgcttcttcagccagttcacgatgtcatcagcctctctgccagctaaccccaaacaaatgtaggttctactctcaaacagggagtgccgcctgccctgccgcgcctgctcccgtctctgctctctgccagccaggctgaggacacctgaatcaacctaagtaagatgttctcccaccatggaagaggcccggtgccgtccgcccgcctcctaaaccccagtgtacgtgagactgtggttgtgtttatggggagtggagagggaagagggtgattctgtctctgaataacaggatcacaaacccattttttttctctgatctctctgcattttcttttttcttttgacacaggggctcactctgttacccagctggagggtagtggcagaatcttggctcactgcagcctccacccactgggctcaagcaatcttcccaacctcagcctcctgagtatctggggtacagatgcacgctaccacacccagctcatttttgtatttattgtagagacggggttttgccacgttgcccaggctggtctttaactcctgtgctcaagcagtttgcccaccacgacttcccaaagtgctgggattacaggcatgagccaccaatcccagcccttttttttttcttggaagacagggtcttgctctgtcacccaggttagagtgcagtggcatgatcatggctcactgcaacctcgaacttctgggctcaagcaatcctcctacctcaggctcccaagtagctgggaccacaggcatgtgccaccacacccaactaacttttttttttttttttttttgaggcggagttttgctcttgttgctcaggctggagtgcaatagtgtgatctcggctcactgcaacctccacctcccgggttcaagcaattctcctgcctgaccctcccgcgtagctaggattataggtgcccgccaccacacccggctaatttttgtatgtttagcagagacagggttccccatgttggccaggctggtctcactcctgacctcaggtgatacacctgcctcagcggtctcccaaagtgctaggattacagaggtgagccactgcgcccagcaatgtttcttcttttttttttttttttttgagacggaatctacctctgtcgtccaggctggagaatgcagtggcgccatcctggctcactgcaacctccatctcccaggttcaagtgattctcctgcctcggcctcccaaatagctggtattacaggcgcccgccaccatgcccagctaatttttgtatttttagtagagacggggtttcactgtgttggccaggctggtcttgaactcctgacctcgtgatccgcccgcctcggcctcccaaagtgctgggattacatgcgtgagccaccatgcccggccaatttttctattttttgtagagatggggttttgccacgttgcctaggatggtctcaaactcctgggattaagcagtccgcccacctcggccttccaaagtgctgggattaccgggatgaaccactgtgcccagccctagctaatttttgtattttttgtagacagggtttcaccatgttgcccaggatggccctctgcattttaaaaattttattttttgaaacgaagtctcactctgtcacccaggctggagtgcggtggcacgatctcagctcactgcaaccttacctcccaggttcaagggattctcctgtgtcagcctcccaagtagctgggattacagacgtgcaccaccacgcccggctaatttttgtatttttagtagagacgggggtttcaccatattggccatgctggcctcgaactcctgacctcaggtgatccacccgtctcagcctcccaaagtgctgggattacaggcatgagccaccgcacccagcctgtcctctgcgttatctaaattttctttgacatgtacatccatcaaacacatgttctcacccaggagtctgacagcaggcctcattttagagaggtggacagtaactcaaaactcagtgccagttttctacctctgggaacaggctgacgccccgcccacctgactcccgcgcctcctaacttatcccaggcgtttcgggagttctcgccaatggcccaccctccatgcctcccagaccaggaagaagatgacacacttttatgccaccaaaggcggtcaactgacaggaaagaaacttcctcctcctgggagactgaggctaaggaatgatgcctctcctttttccctcctagaacttgactccctggtccgaatcgggaaaaccccattcagatgtagaaggattccaccagtgctaacaagacggtcaccagtgacaagtggatttaggagtgctcatctcatctgcaaacctgagtgttagtgacagaaccacggtgactttggacagagcacttcccgttccaaaagtgaacatgagtaaaaaatgagaacatcaatcacgcctgtaatcctagcactctaggaggccgagacgggtggatcacgaggtcacgatcgagaccatcctggccaacatggtgaaaccccgtctctactaaaaatacaaaaattagccaggcgtggtggtgcacacctgtagccccagctactcaagaggctgaggcaggagaatcacttgtacccgggaggcagaggttgcagtgagcagagatcgcaccactgcacgacagagcgagactgtctcaaaaaaaaaaaaaaaaaaaaaaaaaggaaacatcaaaacagccaagtgagaggcaaccacagagctgctgccactagaacaggacagggcacacctgcttaaggggacaaaaggaaacatcaaaacagccaagtgagaggcaaccacggagttgctgccactagaacaggacagggcacacctgcttaaggggagaaccctgctaacactggaatgagctgctttcgggctacccaccatgagcatctgacatgccacagaaccggttttatagacgagttttcttttgccaccgtcactgatctggctacacaggggctcggcctccactacggcagcttcagaggcggcagacgagcagctgagggcccgtgctacagacggagcagggcgggcttggattcgaggtctgctaccgacaggctcgatgctgttactcagctgctctaagcctcagccctttgtctgggaaaagcccgcctcacagagaggatgcgaggagaaatcacgcaagcacgtgacgcggcagctggcacgctacacacgacagctagcaggtgtcaccccgagagctacagccatgctgctgctcctaggaacagggggcagcacaaacagcccatgtggccagaaaggcaccagtctccctctcctcgctggtcagtctccaaacagacctcagccagccgcccccaggatggcaccagacaagacaggttctccattcgaaggttcttccaggatgaaaactcctcacaagaccctcagggcacaagtggacagagaacccggtctgaggaacgggatccctccaagcctctggaacccggcctccccaccgctcagacagctgcccctgcccttccaagtcggcaggccagtccctctctaaagacagttcaagggcagtgccacagccacacctgtatattccttgggggaagccgtgtctccattcctgaagaacttgatggtgggatagccgcgcacgccgtactgctgggccaggtcagactcctccgtggcgtccaccttggccaacctgatctcggaaccttctgccttcagcttcccagcggctttggcatactcaggggccagagccttgcagtggccacaccaaggggcatctggaagcggaaatgagatgctagaaagcagccttgatccctaaagcagccttgatccctcagcagtgcttccctttttcctctggcatttcccttcataaaaaccttatctactcaccaagataacccctcctaacgcacaaggctgagctgatagcctggtgttcttgggcaatatcaggacagaggccgtgaacgacaaactaccaccaaccaacaccagcccccactctgctatgtcaccatcagcacagccagacaaacctttcaatggttgctgacttcttattccccacaggcaactaaggcaaggatctcccctagactttccctttaagactacagacaaaagtgaagaagtgaccgtggcggcctgtaccagcactagctgtgagtatgagatgcacatccgtgcacacagaccctgagttgcttagggtgagaataagacgatctgtcaatagagttagcagctgtgtcaggcacaaggttcccaccccagggacagagctcaaatccttatggacgtgaggaaggcttgggattctcctctgagacaccatcggaaggactgctgtggcaagctgaaggtggggtgggcaggagcggggcgccttccgggtcggcccccggggaggactcggcaaggctggacactggcttgctctgtttgctcacacaggtcgatcctgttcttctcgcactaacaggaagatcctgccgtgcgcagggcgggcatcgggacggccccccggctcccagcccggctctcacccccagggagcccctgacatggcccccaaggcgggcagcaagggagcccttcagttccgggcgcgccgggggtcccgaccccgggggctgccgggccgtgcctgcgtcccaagagcctggctcagcggccccgagccccgcccgcccgccaggcccggcgctcacagaactccaccagcaggtacttgtgggccgccagcgcctccgcgaagttgcttttccgcagcaccaggacgtggtcctcctcctcgggggcgtcggcgcgcaccagggcggccacggccaggcacagcagagcgcggcgcagcatgtcggacacggatcaggcggggcgcttcggttggcgccgccgggacagcgggggcgacgagagcgcgcgccggtcccggcctcgcctttataaatcctgggtccggggcgcgcctgcccccccgcccgcgcgcgctggccgcggcgcgcacgcgccgctggggcccgccttcgattggccggcggacttcgaggctc

SEQ ID NO: 678 - DNA, 8565 bp, Homo sapiens; identical to SEQ ID NO: 676

SEQ ID NO: 679 - DNA, 8565 bp, Homo sapiens; identical to SEQ ID NO: 676

SEQ ID NO: 680 - DNA, 3687 bp, Homo sapiens
ctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctggctgggtcagggaaggcctgccgggggtggtggcactgagagcctgggggaacaggcgccaggccagtggcccagggacggcacggacggaggcaataaatactgatggccaggcggggctcctggctgggcccaggtggggtgggtgaggctgtccatcgagggctcttgggggggcgtgggctctgggcactgcccgctgagacagaaaaggcagaggcaggacaatacccagcctcctggatggtactgaggtgacttgagttttggcaatttggctttccccaagccgccggagccatctccacagccctgtccagggaagggggcaggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcggggctggaggacggcccggcccccacgaggccgtgcatcccacaccccagctccaccccggagcagcagacgcacacgtccaggggcaaccacggggcctggagaatggctgctccgctccctcctgaagccaggcctcgggtgtgacggggagatagaacctggggggcacagaaagggcagcagaggcctggctgcggcctctctcccccacagcacaggcagaagcagcaacgagacaggagaccgaggaggctgggcctgtgggtgggggagggctgaggaggggggtcggaggcactcggttgagccaggccagggaggcggaccagggtgggaggggcacggagggcctgtcagcactttggtatggggaggggaggggctgggggggacacatccgcctgtccgtcgtccgtccgtcagtctgccctgcccgcctctggctgggctcagtccttccagtccttcttgatggtgagattccactcccaggacaggtggtcggtcttgtcgtcgtctgtgaagcgggacttgatgctgtagctgccccgggccagcatacccttgggtgcctcctccacgggggtcaggaactcgtactcctcggcccggggcccatagctgcctaccatgtagtcagtcttgtcaactgcggcacaaggaagagggcggtcagcggccccgcttccccgcctggcagcacgcacccaagcggccccctctgccctgcccggggccccactcactcttgacgcctttcctgtacgtatgctggatgtacttcatgccggacactatctctcggttaacctgcaggacccgaagcgaggatcagggaaggtcggtccggaccccagccccagccccgcctccattccctggccacagcagcctgtagcttacccggaaagagatttttatccggtactccacaccctccttcagcacaaacgactgcttcttgaagctctccaggtcgcctgttggggggacctccccctcaatgactgcccagcagccctgcgcgaagccccagccctgcgcggccccctggctgcacttcccgagatccccaccaggggccgcccggacccccgcggccgcagggcactcacccgtcaggtccagctccagggggcccggggccgagctgcacaccagggtcaggccagtcaccacgacgttggggacgttggggtctggggagtgacagcaggtgagggccccacccccaccagtggaagtaggggctggggagcggcaagacagctggagtgaacgggcggccacccggctcccgcagcccagactcacctgcggaaacggccacgcggcccagcagggcctccttgtactttcgcaggctctcgtcgtccttgtccagctcctggatctcctggatgctcttctgggccgggggcttgtagttgaccgagtgctcatcctcctcgttctccgctgcaatctgggccagctgctcggctgtgggctcctgctcagccatgctcaagcttagcctgggtcgggacacctgtgggcgggacggtgacaggccttggacctggatccccaacggaggcgcacttctgagcaggagtgtgggctgcagccggagctccaaaagggctccaagggggccaccttcgctcctctccacccccgcgattcctgctcaggggcatcctctggggcagtgtgaggtgcccccaccccaggtataacatctaagacaaaatgggaactgcagccgatcatggggagagaggacacacctccccctccacgatggaggaggcagcagccccctgtatgtgtggggcggggctagcaggccccagaatcaaccggcggggcccacactaaaccctctcttagggtcttgccgctcttgagctgcccaggccctcgccctacggggtaacggggctcggtatccctcagtagggttgctcctctggccgtggtagtcacatgtaaacgtgtgtggtcggctcagcgtcatctttcaaacaggatgcccctggagctcggatgttaggggcagctagaataccgcacggggccacctggacacggggatcctaagtatctgcggtttctccacaattgtgagggtctgtgacctacaacttgggagctaccacagccactcagtactctcgggccctcttgtagatggtgggcccggagtgcccggggcagcactgacccggcaggggatctgtcaggctcagatccttcccggcagcgtgggaggtgggtcagggagcagcacacccgggacacccaggccggggtccaggccgccctgcttcctccaggggctggggcctccgcgccgcgcgaggatagccgtaggcgccgggatcctagggcgcggcccgcacttccgcagggcccgcaatccgtgccgggcgtggcccgggcgctgggggaggccgcgccccaatccccgcgtcgcccccgaacgcgatggaccgcggctgccggcccggcgccccccgcgtccccaaggaggggccctcaggtctggcccgggccccacgcgcctcggcggccatgaaagaagctccggaccgctcgggaggggccggcactcccctggtccccgccgcccctccggcccgggacccgcacgtggggccggggccgccgccgcccggtcccgccccggccccgccctagcccgcaccgccctggcccgctgtcaccgcgcccccgcccgccgagaccctgccgcgggctcagggcggggcgcgaacaaaggcggaagcccccacctcagcgccccccgcccccgccggcgccgccggtccccgccccgacccgccgcctccgccccgccgcctccgccccgccacggccactcaccggagggttcggccgcgcggttcaggatccctcccgcactaaatgacgaacgtcgtcggccgccccgcccgccctgcctgtcacttccggggtcacgagacttccgctc

SEQ ID NO: 681 - DNA, 3687 bp, Homo sapiens; identical to SEQ ID NO: 680

SEQ ID NO: 682 - DNA, 3195 bp, Homo sapiens
ctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctggctgggtcagggaaggcctgccgggggtggtggcactgagagcctgggggaacaggcgccaggccagtggcccagggacggcacggacggaggcaataaatactgatggccaggcggggctcctggctgggcccaggtggggtgggtgaggctgtccatcgagggctcttgggggggcgtgggctctgggcactgcccgctgagacagaaaaggcagaggcaggacaatacccagcctcctggatggtactgaggtgacttgagttttggcaatttggctttccccaagccgccggagccatctccacagccctgtccagggaagggggcaggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcggggctggaggacggcccggcccccacgaggccgtgcatcccacaccccagctccaccccggagcagcagacgcacacgtccaggggcaaccacggggcctggagaatggctgctccgctccctcctgaagccaggcctcgggtgtgacggggagatagaacctggggggcacagaaagggcagcagaggcctggctgcggcctctctcccccacagcacaggcagaagcagcaacgagacaggagaccgaggaggctgggcctgtgggtgggggagggctgaggaggggggtcggaggcactcggttgagccaggccagggaggcggaccagggtgggaggggcacggagggcctgtcagcactttggtatggggaggggaggggctgggggggacacatccgcctgtccgtcgtccgtccgtcagtctgccctgcccgcctctggctgggctcagtccttccagtccttcttgatggtgagattccactcccaggacaggtggtcggtcttgtcgtcgtctgtgaagcgggacttgatgctgtagctgccccgggccagcatacccttgggtgcctcctccacgggggtcaggaactcgtactcctcggcccggggcccatagctgcctaccatgtagtcagtcttgtcaactgcggcacaaggaagagggcggtcagcggccccgcttccccgcctggcagcacgcacccaagcggccccctctgccctgcccggggccccactcactcttgacgcctttcctgtacgtatgctggatgtacttcatgccggacactatctctcggttaacctgcaggacccgaagcgaggatcagggaaggtcggtccggaccccagccccagccccgcctccattccctggccacagcagcctgtagcttacccggaaagagatttttatccggtactccacaccctccttcagcacaaacgactgcttcttgaagctctccaggtcgcctgttggggggacctccccctcaatgactgcccagcagccctgcgcgaagccccagccctgcgcggccccctggctgcacttcccgagatccccaccaggggccgcccggacccccgcggccgcagggcactcacccgtcaggtccagctccagggggcccggggccgagctgcacaccagggtcaggccagtcaccacgacgttggggacgttggggtctggggagtgacagcaggtgagggccccacccccaccagtggaagtaggggctggggagcggcaagacagctggagtgaacgggcggccacccggctcccgcagcccagactcacctgcggaaacggccacgcggcccagcagggcctccttgtactttcgcaggctctcgtcgtccttgtccagctcctggatctcctggatgctcttctgggccgggggcttgtagttgaccgagtgctcatcctcctcgttctccgctgcaatctgggccagctgctcggctgtgggctcctgctcagccatgctcaagcttagcctgggtcgggacacctgtgggcgggacggtgacaggccttggacctggatccccaacggaggcgcacttctgagcaggagtgtgggctgcagccggagctccaaaagggctccaagggggccaccttcgctcctctccacccccgcgattcctgctcaggggcatcctctggggcagtgtgaggtgcccccaccccaggtataacatctaagacaaaatgggaactgcagccgatcatggggagagaggacacacctccccctccacgatggaggaggcagcagccccctgtatgtgtggggcggggctagcaggccccagaatcaaccggcggggcccacactaaaccctctcttagggtcttgccgctcttgagctgcccaggccctcgccctacggggtaacggggctcggtatccctcagtagggttgctcctctggccgtggtagtcacatgtaaacgtgtgtggtcggctcagcgtcatctttcaaacaggatgcccctggagctcggatgttaggggcagctagaataccgcacggggccacctggacacggggatcctaagtatctgcggtttctccacaattgtgagggtctgtgacctacaacttgggagctaccacagccactcagtactctcgggccctcttgtagatggtgggcccggagtgcccggggcagcactgacccggcaggggatctgtcaggctcagatccttcccggcagcgtgggaggtgggtcagggagcagcacacccgggacacccaggccggggtccaggccgccctgcttcctccaggggctggggcctccgcgccgcgcgaggatagccgtaggcgccgggatcctagggcgcggcccgcacttccgcagggcccgcaatccgtgccgggcgtggcccgggcgctgggggaggccgcgccccaatccccgcgtcgcccccgaacgcgatggaccgcggctgcc

SEQ ID NO: 683 - DNA, 1560 bp, Homo sapiens
accacgtgtgtagacccaggccccctcacctgggagtcacgtttattgaaaaagtaaaaagtgtcacagtaaaaaattcacctggggacaaagccaggcctaggaggggtggcggggtcgtggagggacgggtccggccgcccctggcccacgggtggggcacgtgctggcccatgggcgacgcgcggcttctccagggaggcggccctgggcgcgggggcgggcgggcaaagctggctcagtccatcgtggtccctttgaagagctccaccagctccttgtagtccgggtcgatgaggtcggagggcaggtcgccatcgtcgttggttgcatccctgtccgctcccagggagataaggtacctggggtgtaaaggtcgctctggctgaagcggggaggagccaggagagtgctcgccccaacccgggtcagagggccagagtcctggggtcacctgtgtgtcccccaccttggggtcctaaggtccgggtagggtgaggaggaagaaacctgaccctttggaagctgtggccagcttttcaagttggttctattgaggacaaaggcagaaacaggattccagaagcctctagggtttgcagggttctttttttgttttttttgttttttgagacagaatttcgctcttatcacccaggctggagtgcaatggcatgatctcgactcacggcaacctccacttcccgggttcaagtgattctcctgcctcagccttgagtagctgggattacaggcgcgcgccaccacgcgtggctaattttgtatttttagtagtgagagggttcttgtcacgaactcctgacctcaggtgatccgcccacctcggcctcccaaagtgctgggattacaggcgcaggcgtgagccaccgcccccagcctctagggttcttgccgacaccacccgggctacattttggggctcccatcctggggacccactgaggcccggaggggtcgggttcaagcctgtgtagacccagggccccctcacctggctatgtcagggtacccatcgctgcaggcaatgtgcaggggtgtccagcccgcctcatctcgctggtgaatgtcagccccgtatttgaccagcagcttcacgcattccaggtttccagagagcacggcttcatgcaaggcggccaggcctgggcagggaggacgggaggggtcaagactgagccccaggtcaggtcctccttgctggcctctcccaccaccccacaggccctggccagctcttccaggctttgctcacctgaggggtggatggtggccagggagactttccgagtccggatgaagcgccccacctgctccaggtcaccctgccggatgtggtccaagaacaggacatcattagggaaacgcacgctgcgatcagccagcatccgccgccgccgctgccgtgggctgtagcgggcatagcgggcagttctgctaggcatcttgggcgctgtggggcaggttgcccctggggaccctactgcactggggttaataatgtatccggtcccgaccagatcagcttgagggctcctgtcg

SEQ ID NO: 684 - DNA, 711 bp, Homo sapiens
gccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtgggggtgcggcggcccctcagcctttgcttgcctgccccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccccaccgtcccactcggtgaccccaggcccctccggcgcgggatggcgccccaggtctcccctactccgctcaccccgcagttaatggcaaacgaataaataaatgaggcggcctcgga

SEQ ID NO: 685 - DNA, 3753 bp, Homo sapiens
gttccagttctacacacatttctattttattatggaaaaggtggaaacgccaccttctccacaacagcaaccagtaaaatttatcccaaaaataactcggtacaaaacaggtctgtttcagaattaaaaaaaaaaaaaaagaaaaaaaaaaaacctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccatctgaaacacagaggagaaagaggcttgcattcacaggcggcctgctccccactgcggctttgaccaggcccccagctggctcccccgggactcactctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctagcaaggaagacgaaaccgttcacacacccggaaggaccctaagagcgacgcagcctcaccctcggccaatccccttccccagaggccccggaagtcacctctgtgcaggcctccgctgtgcgtcaatctgtgacgtgacaagctgaatgttcatggggcggcctgcggcaaagaatacgagaaggcacgttctattgagaggctctgaaacccacccagctggcgccacaccctggtctccatgcaaacactggaaagggcctctgtgcgtctcaaatgcccccgacaagggaaatggcctggagatactggtgggagaacaaaatggcaaggaagcaaccccaccaacacctcctcactccttctcagtccagactaggtgggctgctcgctgaggtatcggggtgctcgtgggtggagaggtgtgggtgacctgacgaagaagaaccggtacctttgtctttacgactacagccccgcactcagaggtgtactatggcggttctgagaaggcttcacagaagtgaatcttccggaaggagctgaaggaggggagggatgtagcttgctggatgggggttcacaagaggttggtccagatgtgtggggcagcatgagaggtggcagatggaagagagagacaaaggggcaaatgcaaagtgtcctcagccacaggggtaccccatattcctacctggacaggtgccagccccaaactccacaagccccacagtcagcgtgggtccacccccagactcaccatccagagggacgccgttgtactgcttcatggccttcagggcatctgccttccgctcaaagtgcacgtctgctgttcctaagctgcgaccagagcgatcatagtgcacagccgccttcttcagcgttccaaattcagcaaagagttcctgggagttgcagagagcagttgtcagaaaagcaacaaaactgcgttccttctggtggcccagggacaggccctggaagcgtgagttgctttgggggtggttctctgggaggcaggacagtggttaacgggaaatgagggaagggcggggcaggagggacagcaacttccaagagcacctgggtctgagggctcctgccattgtggggacctgacacgtgtaccacgatgcaggtagaggaagctgcaaagcccactagcaacgggcacaaaattaagccactatcctcttcaacaaaggaaaatgtacaacacacccaagggctgttccaagaaacggtaaaggccaaaatcaagagcaagggaagcagtccgatatcagaccagcttgaagggcctgtagattcgggagccctgaccccagcccctcccccaaaggcagattctggctcacctttccctctcctcctactcaagcctgcggcaaagtctgaagtcaagcgctgtcatggaaactgccctgacctcaggcaggctgggagttggagagggaacccagagtgtggggatactccggccgcaggcacacagcgggaactggagttcaccaaaagcggtttccagtggatgctagaaaccaccttaaaaaaagtgttgagacactgtgagtgctcactggccctactctgtcctcccaaggcaaatggctgggctgtgggcaactgaaccctgcccagccatctccaaaactgattcccaaaaagtcatttcttaaccagaaaacaagttgaaatgccattgggattcaatttttctttttttaaaaaagaaaagcttcaaccaaagatggatttgagagtcatgtcactgacgggacacggcggtggggagtgataaaaccacagcgtacaaggtctttataagacagtactcaaggcaaacagagccagaaaaacagactccctgtgcttcacaagatacataaagaagattctttttctcacattaacccactaagacaggcacaaaatttaaaaagcaactgggctgggtctaacagccaaaaaccactcacatttggtcagtctttgtccctgttagaaactggaagccctggcaggggattttcactcacagaacccatcttcagactaacagcagcagttcctcaggctcagctaggctcgcacctgcctgcgcactgaccccggctttactagcactgggtctgtcctgcagcccttcagagctgggagggctcccttcgctaaggcgggaaggggactcagggccacatccccaaaatcacgatccgtcctgtgcagggcgaacggctcaccgagaagccctcgtctcttacctgaatatcggcgtctgagactccaaaatccagattggacaccagcagtttcccacctgtctccacgccggcaccaccgccgaagccactgtcgaaaagatcgtgctgccacttgtcgggaagttgttttggctgaaaaaaaaaccgcaacaagagcagatctgtgagtctcagtccagggctttcctgaccctcacggctactccggacccttcctcttcccggcctgagaggatccggccgaaacggggccgccagcgctccctccggcgctgcagctgccccagcccgaggccgcacggtcccaccgcggccgcacaacttcagttcccttagactaacttcccgccgcctgtgccgcgcccagcgtcccctcctctcctgccacgaggccccaacgtccggaacaaacaaagagctgggaagggtctcagcctccgggaccggaccccgaaagaacgacctcgctcccgcccaccaccccctccgcgcccacacgcaccctccggacctccgggcggccgctccaccagccttatccacccgccggcccgggtctccgccgcgagcggccccggccccagccccggctggccccctcccactctccggcgcggccggcctccgcactcaccctgctgtagggcgccggtcggttcctgccgcctccgccggccgcgccgcgggcgatggccggccggttccggatgggcccgccgcctcgattcactcgcgcggcggcctgcgccccaccgccgcggccgccctgggagccggcccggccgcggccccggcccccgccccggccgcctcgctggctccggttcagtttaatgatgtcgtccagagacatgtccattttgtcggccatggcgggcgcggaatcgggcatcggctc

SEQ ID NO: 686 - DNA, 8565 bp, Homo sapiens; identical to SEQ ID NO: 676

SEQ ID NO: 687 - DNA, 8762 bp, Homo sapiens
cgtgcgcactggcgtgcgagactcggcgggcgctgttgagggagtcgggccgcgactgtggtcgtttttataccttcccgcgcggacgccggcgctgccaacggaagggcgggtagggcggtgcgtgattaggttggcgaaggtgcgagggcgcagggggtggggcggcggccgttggaggcggagcctacgcgcccctccctccccgcacgctccgcccgatcggccagggctgggggcgctgggggcgctacgggcgcggcgggtgcctgggagctgctgggagtccttgtttccgctcccgcccaggactgtgcgctcggctcgcggtggggtccggcgggcgcggcttcggcgggcggcagccgctgcagacgagctgcgggttggttttttggtctccacctgcagcccccccaagtctgcactgtcacattttgccagtcatatcctttacaagttttcttgcgggccgggcgcgggcctcacgcctgtaatcccagcactttgggaggccgaggcaagaggttcgcttcagcccaggagtttgagaccagccggggcaacatcgtgagacccccatctctaaaaaaaaaaatgagctgggcatggtggtgcacttctgtactaccagctacttgggaggccgaggtgggaggattgcttgagcccaggaggtcgaggctgcagtgagccgtggtggcaccactgcactccagcctgggcgacagagccagaccctgtctccaaaaaaaaattatttttgcaacttattaatgaaaaccagtgtgccatttcattgattttttttttttttttttgaggcagtctcattctgtcgcccaggctggagtgcagtggggcgatctcggctcactgcaacctctgcctcctgggttcaagcgagtctccagcggcagcctcccgagtagctgggactacaggcacgtgccaccatacctggctaatgtttgtatttttaatagagacagggtttcgccatgttggccagggtggtcttgaactcctgacctcagatgatccgcccgccttggcctcccaaagtgctgggattacaggcatgagccaccacacccagcccatttcatggattttaagttgttttgagatacttgcttttgtttttgttttttgagtcagggtctccctccgtcacccagagtggagtgcagtggtgtgatcttggctcactgcagcctcaaactcctgggctcgagctatcctcccacgtcagcctctcaggcagctggtgcacgccaccacagctggcttttttttttttttttgagacagtcccactatgttgcccaggctggagtgcagtggtgcgatctcggctcactgcaatctctgcctcccaggtccaagtgattcctgtggctcagcttcccgaatagagctgggagctggcgtgatctcagctcgctgcaacctccgcctcccaggttcaagtgattctcttgcctcaccctcccgagtagctgggattacagttgcccaccaccacacccggctaattttttgtatttttagtagagacagggtttcagtatgttggccaggctggtcttgaactcctgaccttgtgatctgcctgcctcagcctcccaaagtgctgggattacaggcgtgagccactacgcctggcctctaatttttgtttttttggtagagatggggtttcaccatgttggccaggttggtctcgaactcctgacctcaagtgatccaccctcctcggcctcccaaagtgctgggattacaagcatgagccaccacctgcggctaatttttttgtattttttgtagagacggagtttcgtcatgttggccaggcccatttgagatctttgaagatatcctcaacgtgaggtaaaaccaaactcctgactgtcctgtgctcccaaatgtgatctccttgtccgtaaggagctgagtcccttcccttggagagaagagtgtgccctttctctagatggctaaagaaacctcacagatagttcttttttttcctttttttttttttttttttttggtagagactcagtctcactgtgttacacaggctggtctcaaactcctgagctcaggcgatcctcccgagttggcctcccagagtgctgggatcacaggtgtgagccacaaagcggattgctgctggggcttgctgttctcccgtagctcccctgcagccctgaccctctgggcccagagccctttacttgttatttgttttaatagaaacggggctcatagcagggcataggggttcacgcctgtaatcccagcactttgggaggccgcagtggcagatcgcttgaggccaggagttcaagaccagcctggcctacatggtgaaacctcgactactaaaaatacaaaaattagtcgggcgtggagtcacgtgcctatagcctcagctactcaggaggccgaagcacaagaaatgagctgagatcatgccactgcactacagcctgggtgacagagtgagactctgtctcaaaaaaaaaaaattaataaaaataaaagtaaaataaaatagaaacagggctcacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagccttccaagcagctgggattacaggcatgtgccaccatgctgggctaatttttttatttttagtagagacggggttttgccttgttggctaggctggccttgaactcctgacctcaggtgacctgcccgcttcagccttccaaagtgctgggattacaggtgtgagccactttgcctggcccacatttttattttcttttctttctttcttttctttttttttttttttttttttgagatggagtttcactcttgttgcccaggctggagtgcaatggcgcgatctcggctcactgcaacctccgcctcctgggctcaagcgattctcctgcctcagccttccaagtacctgggatcacaggcatgtgccactacacccggctaattttgtattttttagtagagacaggctttctccatgttaggctggtctcgaactgtcaacctcaggtgatccacccgcctcagcctcccaaagggatgggattacaggcgcgaaccaccgtgccccccccaacattttcattttcatctcatgaagaaaagttgatagaaaaaaagccaggtggttggtacccatgtttatataaagatcctgtcacagactccataggatgaaactcagctgtgaaatacgtgggattaaaaagagattagagtctgggcgggcagatcacaaggtcaagagatggaggccggcatggcggcccacgcctgttattccagcactgtgggaggccgaggcgggcggatcacaaggtcaagagatggaggccggcacggtggctcacacctgtcatcctagcactgtgggaggccaaggtaggcagatcacagggtcaagagatcaaggcagggtgtggtggcccacacttgtcatcccagcactgtgggaggctgaagtggatggatctcaaggtcaggagattgagaccatcctggccaacatagtgaaacgccatctctactaaaaatacaaaaattagctgggtgtgtggcgtgtgcctgtaatcccagctactggggaggctgaggcaggagaatctcttgagcctgggagacgggggttgcagtgagccaagagcaagactccatctcaaaaaacaaacaaaaaaaagattagtttaaactttttatttgaaaattctcaaaattgaatggcataggccaggcgcagtggctcacacctgtaatcccaccactttgggaggccaaggcaggcggattgcttcaggccaggtgttcgagaccagcctggccaacatggcaaaaccccgactctactaaaaatccaaaaaaattagccgggcatggtggcaggtgcctgtaatcccagcactttgggaggccgaggtggatggatcacctgaggtcaggagtttgagaccagcctggccaacatggtaaaatcccgtctctactaaaaatacaaaaaagtagccgggcatggtggtgcatgcctgtaatcccagctactcaggaggctgaggcaaaagaatcgcttgaacctgggaggcagatgttgtggtgagccaagatcgcaccattgcactccagcctgggcaacaagagtgaaactccatctcaaaaaaaaagaaaaaaagtggaaatgtttgattatgtttaggttgaaagcagagttttgcatcagcgaaatggtttttcatgagaccgaaatgagcgtaaagcagaagcaagggtcaaggttttgcccagggaggacaagaagaactccccagaggacagtggggaatggagaggacagtggggaatggggaggaccgagaagctactcactaccccaagtaaccaggcgtatttttgtagggccaggtgcatgcccatattgattgacagggtctcactgtgttgcccaagctggacgtgaactcctgggctccagccatcctactgtctcagcctcccaagtagcataccaccacactcatctgcctcctttgctttttttttttttttttttttttttttttgagatagagtcttgccctgttgctcagactggagtgcaatggcaccatctcagctcaccgcaacccccacccttctgagttcaaaggattctccggcctcagcctcccaagtagctgggattacaggcatgcaccaccacagccagctaatttgttgtatttttatttttattttttatttattttcgagacagagtctcactctgtcaccagggctggagtgcagtggcacgatcttggctcactgcaacttccgcctccctagttcaagtgattctcctgcctcagctttccgaatagctgggactacaggcgctcgccgccatgcccagctaatttttgtagttttaacagaaatggggtttcaccatgttggccaggatggtctcgatctcttgacctcgtgatccgcccacctcagcctcccaaagtgctgggattacaggcatgagccactgcgcccagcccttgttgtatttttagcagagacagggtttcaccatgttggccgggctggtcttaaaactcctgacctcaggtgatccgtccacctcggcctcccaaagtaccaggattacaggtgtgagccactgcacccgcccctgtctttgcttcttaaggtgaaattgagatgactgaatcttagtacaattttttttttttgagacagggtcttgctgtcacccaggcggcagtgcagtgtggcaaaatcatagctcactgtagccttcaattcctcagctcaagtgatcctcccacctccacctctcaagtagctgggaccacaggcatgctccacaatgcctggctaattttttatttttttattttttgtagagacagggttttgctatgttgccaaggctagtcttgaactcctgggctcaagggatctgcctgccttggcataccaaagtgctgggattacagacgtgagccaccatgcctgaacaaaactacataaatttttaattttttttgtggaaatggagtctcactatgtttcccaggctggtctcaaactcttggctctgtcctgccacagcctcccaaagtgctgggattataggtgtggcgcctggcccgtacaaatactttttattctaggcttaacttttacattggccctagctaaatagaaatctcatcactcaggaattaatcctcatttaatcaaacgggtagggtgtaatcttaggaaattattgattgactctacctgattggatttgtagttaatagctaattaggttaataactaaattcacaaggcacagttttatttgatctcttttaaattgctcttaaggatgtaacaaagagtgcgtgggatgccctgagggcaggcattcgacttctggagcagcagcttaacttctgaaattcctccgaaccatgtgtccacacctcgtctggctgcatccgtgggccagatgtgggtggtgaatcctgtggattagaggtggtgctaggtagcccccaagtgactgcagtggtgggtccacaggcagcctgcagagcccgccctgcagcatgccagctgggcctgtgatggggcatccagagggtgttgccctgaacactcagcatgtctccgctgacacagtgtgctcaggctttgttaacatggggcctgttggctgcagagactcaggagttgagagtctaatttttggacctgctgatggttaagtcatagtgagtcagtgttaacgcgcaaagcgtttgacgagtccaatgtgcttccatactaagcagcaccaggtttcttttgctaaaattgaactcctgtgaaaaattcagagtgactaagttcattcaacaaagaccgtgggagcccgaggctggtaaacaatgagtccatcccgcatcccaggggactctggtggcagtgcagttttgccgagaggagttttaatttaaaaaaatgcaatcaggagaccagcaggtcctggaatgagtcaccctcagtgcatctgcggactcatcagacaccccaggccggcttcgggtggggaatgcactagaacgaagtgacacctttgactaaacgaggcctcccccgagtactcagagtggcccagacccctctcctcagggggctagcaggcttcagctctcatttgaaagggccgatatcaagcagagttgtgctgaggccagaaacccccacgggcaggtcctcccagggctgggagtgggcatgccgtggggccggcgctgccaggacaggagggtggccacgagctccagctccacaatgccaggccgaccctgccgtggggctggggctgggacttgctgtgctctgttggcagcagctgttcctcaggggtttccaggctcttggagatcagggacactcatttctcttgatcatggctgatacaagcatccctctctgtgtcaggtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctaggtccccagaccccacccctcctgcccttgatcaagagaccagttcactactcagatgcacgtctccttggtgccttgaccattcatgtgacctttttggcatcacagatcaagtgtctgcagatgggcccagggcctgtaggtcagacattgccctttttccccagcctcaagcacaggggacacagggtgggctaggccagagcgccacctcctcagagaggcccctgggctccccactgagcatgatgagcctgggtgaggggaggcgcctgctgcggttgccccgggtggaggccgcatgtccggtgtcccttggtcattgctggtcttcgcctgggggcgggctggtcaggagaccgattgggtaacactcctgatttcggcttctctgaaacatgagaggctgcagtgctggagccactgcccagggtccctacctgcacccctgcctggcttgtcacatgctctgtgtccagcctggtcatgcctgtccttttccccacctcccctccgtaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcagg

SEQ ID NO: 688 - DNA, 8565 bp, Homo sapiens; identical to SEQ ID NO: 676

SEQ ID NO: 689 - DNA, 8302 bp, Homo sapiens
ctcggagtgaggggtgctggaggactggcagccaggccacgaggggaacgggacctggaaatccccaagcctgggtatgagaaggcagccgagtgtgcggcggcagggcaaggttggcctgggccgcccagaggtcttcagacccaggggcgaagctggccacgacccagccccgcggtgaagccgcgcctagccttggtgctccctgggggaagtgcagggccacggctggcccggttcccagtgtcctcccccagcccttcgctccccaactcgagagccaaatctgtgagggcatgggctggagcccctggctgccttcctcttgcccccatcccttctggccaggccaagtccgagggtgcaggggcaaggaggagagttgggggcctgagccctggctccagaggcccagagcatgcctccccagagctgaaggtgggagatgggtaggttctccctccgccgttgggtgtgactccggaactggcttgggctctggcctccaatgctgctacggggccaggcccacctccgggcccaggcagcagcactgcagggcctttctaccctccccaagcctggggcccaggcagcccctgtccagcaccaatctgtctatggggaactggctggtccctctgctcaggggaccccgcagtccagggttctgagtgggagcattggcaccaccccactcctgaaagcgggggcctggcaggatgaggatggcctgtgccccccacaccttggcccctggctcggagagcagggtgacaggctgccttcctgggctgtggagagcctcgcgtgcacctcgcctccagctcctgtgctgggtcgtgaggtcgacctcacaacagcagaggacaggcccatggggtgccacatgggccaggtgctgtagggcagaggccattctggagaggaatgtggggctgaaaaaagtactgatcataagcctcattttgaatgcggcgagaccaggcaatctatggcctccctagacacctcccggaggctgcagtaagaacctcttcggcctctgggctgctccaggcgggccgtgacaggggtgtgggagacagagatcccatggcccctggaggggccaaggggcaaggagcctcagctctggctctcctccttattctagcatcgcctgctacagggggtggccccaggctttggagggctggaggcccgggtttcactcactgccaggctgcccgctgcactcccggctgctgggtgcatggtgggggcagggccaagagggtctccttgctgagtggttccctggtccttcccagcagggctgggagccccgcgcagcactgccaccaggctttattcggttgtaccaaagagatttccgtcagccatgtacaaacagaacagagtccataaggagagtggcgaagctgccgggaaggaaggcaagcgtgttttcctggagccaggcgctgggtggcaggacaccgtgttggggggtgcccagtgggaggtggtgtggtctacacccagagaactaaaggggtgaccgcagtcactgctccctaaagccctctgctctgcacctcccgccacagctgggtgggcagtcagtgtggcctctgtccaggtggtgggggcatccggggaccaggtgggggcgcacgcaggagcggtgcgtttcaggctgcaggtgccgtctgcccgtctcacttccggcctctccactgtgctggacaccctctctgagcagctttgctggaaagagcggagagcctgctgcaaaccaggcaccttgtaggcaggcaaggaggcagagtcctcaccagcccttccagagccaggccagttagagagggcagccctgcagagtcctatgtccaaacgcagaaggcgcagaagcagagcagggggagggccggccagggcctctgccaggttagaagtcaccatcgcgctcccccaggggctgtgccgcctgctgcctggcagcctccaggaaggccagctccttggcttccttcttctggtttcgcgcctcatactccaacctgagagggcagggtaagtctagcagagagcgcccatgaggcggctccgagggggagggcagggtaagtctagcggagagcgcccatgaggcggctccgaggtgcccccacccaactgcacctgttggtgatgatccgctggacgatgaggtctgtggtgaggttgctgccactgtcaatctgacggaagatgccccttctcttgggctcctgggggtccagagaggaggagcgggatgaaggtccctgctgacctccccaagacccatctgatgccctgccccagagggagaccagcgcccagggtcccatgggagtggtgcagtcggagcagctgcgccaccatgcccgtttcccaggcaggcacagtgagtcattaaatggctgggaggtgccaatggcaacccctgtgcccagcaagggccagcatgacccacctggtatgggtcggagccatccctgtcagggataatttctgtcttgccgtgacacaccaggtccacctggagaaggagtggggtcaggagccctccccggggaggcagcggccgtcgccacccacagcccagcacaggccccgggggttgggagagctgaccctgccctttcctcagcccaggtacctcctgggccccgcctaggagcccacagccagcctgcattcccagcccatgcaggaacagaggtgaacagagggaacgaggtgagcccatgcggagcctcaccttgaagtgacttaggagctctgctgtgaccgcgtacggggctccaatcaccacttctgacacgtactgtggggacagtgggggcagaaagacttgctcggtccctgctactggtaagccagggccacagggtggtgagagacggctcagacatggggcggggctgccagtgagtagcagggatgggctgggcaggctggggacccctggggctcctccatgagacaagaaggaacagcatctggagacctgaccacccctcctcatgcctcaacaaacaggtatgggcaggtgccacagaactcggggtgctgggtgcagctctgccagtgacccaagcccccctgccctggctcagggaggcccttagtaggggggatgttgtgggaatgtctccccatccttgggctggctcctggcccccactcacccggcaggccagcacgctcagagtccgttcatgcagattcatgatggggtagttcttccccttgtagtgattgacctcctgcggccagagtgcggctagctcagcccggagactttttggggggacagggtgtgcccctcccggctgtccctcatgggaagaagtcggggaggttgctcgcccttgtggggatgccccagacaggacagccctggaccccagaagcctacgatcaccccccagggtctcctgtgacttcacctggggccccttcccagagaccacctgcacctaacagcaacgcttagggcccctcgagggcccatcagctgcccaggggcccagggagcaagaaggcagtgacctggtcaaagtgtaagcccgcgatgatgtagggcctctctgccagcctgtgcaccttctccaggaagtccacatgcccgatgtctgcacccaggttaagaagcagtcgggatggggatgacagggagcagctccctgacagctcatgcccaagggcctccccgccatcctccctgctgacagctgctcccctgcaaaccagccagcccagtctgggggccccaaggagtcaagtgaggcccccgggtcccaccccatgtggcacatgtaggggagcagcagaggcccagaggatacggaacaggtcgaaggcaccagccacatagatgactgtctcccctggctggggctccttcccagaagcaaactggatgatcttctgagatgtctgcaggaactgggataccccggtccaggggttccgcccaccagggcactgcaagccaagagagggagcaggttggcgggggaggcctcccaggtgctgccctcaccaggtcaccaaaccctcagctgtcacctgccagcaatcccatttccagccagtcatctcgggcaggggacacactgccaggccaggtggcaggtgggactgtggcgccaccccacaaccacagcaggcaccgcagcagacaccacttcagcccagcaagcgaccaccaggaggaggcaaggagccctgtggcaggtgcacacagcccttgggagggacctggtaccctgagaccactgtctggtcacctgggagcagccttctgaggaaagtatgtccccggcgggtatcgggtgagggggctacaatgggagagagggccaggccacttggttagaggccacctgtccacaggcaaatccttgctcctccaagcagtggctgccgtgaccggccagccggtgccaccacccgcctgccctccctcccagcatccaccagtgagccaaacctggcagtcagtgcctggtcagtgccagggacagagggaggagggtgaggctctgggctggcctttccccaagggatggctgggacaggtggccgggggagccccctgcagctgcgtgctcagctctccctgcacagccgcactcaccttgccaaaactgtctgcatactcccggtactcagaggacatctcctgcacagaaggtcagagcagggctgaggggcctgccctcccggcgtggccaccccagaaccggctggggatggggagcagtgggcaggaggaccctgagagggcagggaggtgcccctcctttcccctggagacctcgacccaggggcctcggggattccgccgccgactcacctggctgctgtgatgggctttggttaccagcagcatgcggcccacgaggtctgtggtggacaccccttgcgtgcgcttgcattctctgggggacacagtgggagtggggtctcatcctgggacactcgcaaggctctgcctcctgctaccaccactagggacactagcagccctgctgtggcagaacccacggctgccccaaagactgagggtccccttcctgtgcaaggccataacagaaaacctgggttgggaacatggggaaggcctccacgcttttattgactgaagggagtggcaggagcacagaaaaggacccttgctggggcccaggtgtgcaatgccagggagaggatgggcactggggtagcagctctgcttcctgcctccctcacacccacgtcctgcccgctgagcatctgcagctgagtgaattctcagctgcagcatctcatgcgggagccactggcctcatgtccctgacgtctggtaattcagatatagtgccagctccccagcagtgccagccacgtcccccgagctcaacagctgccacctcacaaagctgtgcctttggagccctggggccatgggtctgcagcaccaaatggcaagggcctccaggccaccccacaatggcacctccatccctcgagttcccagtcctgggcgtgaggaacatggcccagggcctggacgctcccctcacgggctcccggtaaatagcaaagcacgagccaggagggagccccgtgtccagctccctggatggccaggcccgcggtggagactcacctgtacctcccagcctgctttacttcctcataggtgtcccggccatctacagtcagggtgatgtcatctaagcagtgacacacaaggacaaggatccttaacccaaagccaccagaaccttcagagcccaggaccctctcggcccctggcctgccctagtgtccgcgtgcccatttctaggtgggggcccggaaatgtctcagatcctcaaagggcggaggccccctgttcccggatgtcccaccagcagatctgatcctgagccacctgatgtccccaggcccccaggtcccagccccgccactcactgccgtgaacacagaagtcacagttgtatttgtccagggtctctagtgtagtgacgtagggagccgctggcaccacctcgtccacccatttgatggcctgcaccatcttgtatctctcctcctgagtgaacaccgggggccccttgtgcttggcgatctcctctaggaaaaggacaacggggagactggggaccccagcccacccggcccctccagtaggaggccccttcccagcacccagctgtagccacacaagagggccggtgggggcaggctgtctctctaccctggcccttagcccactagtgctggccaactgggtggctctcttccctgcgagggtctcaggcaaaggcagagattccttctgacgagcaggtgctcagcccctgaaggcttgggagcctcgctggcagtggtggggagcaggtgccccttctctttagctgggacaggaaatgcaagatgggaaaggcattaggccatcctcagctggggctgggctgggtgagcctacagtgccctcccctacagctgtgccctggcaaggtggccccaggcctgcaggctttcagtcaacagtcgcaacccacaggagggctggggggccgcgggtgggcgaggccatctgtgcttaccatcggtgtgcacgcctacgatgaggtagtcacccatggcccgtgcctggcgcagctggttggagtggccgtaatgcaccatgtcatagctgtggagacagagagagtgggtggtccctgtgccaagggtggggaccaggtgtccctgtgggttaggggcagagctttgctcctctgaggactccttaggaagcgctctgagaagctgctgctgggagccctgggactgggattcggaggatgtaggtgctcagctctccaccccactggctcctgggcctgacggtgggacccctgtgccagatctagaaagggtggcaggggcagagatgtcaaggcctggctgggtctagaggactggtgggtgcaggacagactggagcccactgaaagctgcagggccacgtgtcctatcccctcaccaaatatcaactgccctgggcagtcactttaaaataagccgatgttaactcttggggtagggttggatcctagactaccttgagacaagcaaacagtccctggggctaacccaaaacaaatccaaccacaaaataaaaccctgggaatcactggccctgaaaatcctgtctctcctcccttacggcctcaagctcagcaggcttaacgctaagggtgaacagccactgccttgccacctggctcgagagttttcattcacaaatctaggtctgctaacacgtgaactctcaagcccaaagctacacagccctgccaccaactgggcctcgctgccctggcttcttcgccacttctttacagcagcggcccatcccctcaagtggacaaagctgtccctgcctctccagggagaggtgtgaccctggcagcccacacagtgcacagagttgctccactgcacaccactgcttcctcccagcacccctgccacagtgcgcggagcccggcagacatgctgggtaaaatctggcgggcccatgtacccactggacaggctggaggggaggagggggcagaggctgggccaggggagcacagtctggaatggggctggggcctggtcagggcaaggtcaaagtccactgacacaaagccacattccttttcccagaggtgactcggacacagaagacaaggccctgcttgctctcctgggaagggctaatcagatagaggcgcttgcttcctggattccatccggcaggcacgtgaaagggtcagaggtagcaaattatcagtaacggtcgtcttcctttcacttgttgacaacccgaaacttttcttaaaacaatgccctctgactggccagggaagaccgatcgcattctagccccgcggaggaggacccgggagcccgcgggcttcaccgcgggtcccggacaggcaggtcgcacccgatgcccacctacagggacgctcgcccggaggccaggggaacccctggaccggagccgggcaagctggttgctggtggttacggagaagcagggaggccgtggctccagatctcagcgcggtggctgcaccggagaggtcggcgtgaccgggcggggcctccgccagaggtagacggggtcgcccacggcagggcgcggagcctctgcagcccgaccctcccggcaggcgagccccgcagcctgccagccccggcccatgccggacgaggacgccacccagaacgcgggcccggtccccgggcaacggct

SEQ ID NO: 690 - DNA, 8302 bp, Homo sapiens; identical to SEQ ID NO: 689

SEQ ID NO: 691 - DNA, 8543 bp, Homo sapiens
cgatcggccagggctgggggcgctgggggcgctacgggcgcggcgggtgcctgggagctgctgggagtccttgtttccgctcccgcccaggactgtgcgctcggctcgcggtggggtccggcgggcgcggcttcggcgggcggcagccgctgcagacgagctgcgggttggttttttggtctccacctgcagcccccccaagtctgcactgtcacattttgccagtcatatcctttacaagttttcttgcgggccgggcgcgggcctcacgcctgtaatcccagcactttgggaggccgaggcaagaggttcgcttcagcccaggagtttgagaccagccggggcaacatcgtgagacccccatctctaaaaaaaaaaatgagctgggcatggtggtgcacttctgtactaccagctacttgggaggccgaggtgggaggattgcttgagcccaggaggtcgaggctgcagtgagccgtggtggcaccactgcactccagcctgggcgacagagccagaccctgtctccaaaaaaaaattatttttgcaacttattaatgaaaaccagtgtgccatttcattgattttttttttttttttttgaggcagtctcattctgtcgcccaggctggagtgcagtggggcgatctcggctcactgcaacctctgcctcctgggttcaagcgagtctccagcggcagcctcccgagtagctgggactacaggcacgtgccaccatacctggctaatgtttgtatttttaatagagacagggtttcgccatgttggccagggtggtcttgaactcctgacctcagatgatccgcccgccttggcctcccaaagtgctgggattacaggcatgagccaccacacccagcccatttcatggattttaagttgttttgagatacttgcttttgtttttgttttttgagtcagggtctccctccgtcacccagagtggagtgcagtggtgtgatcttggctcactgcagcctcaaactcctgggctcgagctatcctcccacgtcagcctctcaggcagctggtgcacgccaccacagctggcttttttttttttttttgagacagtcccactatgttgcccaggctggagtgcagtggtgcgatctcggctcactgcaatctctgcctcccaggtccaagtgattcctgtggctcagcttcccgaatagagctgggagctggcgtgatctcagctcgctgcaacctccgcctcccaggttcaagtgattctcttgcctcaccctcccgagtagctgggattacagttgcccaccaccacacccggctaattttttgtatttttagtagagacagggtttcagtatgttggccaggctggtcttgaactcctgaccttgtgatctgcctgcctcagcctcccaaagtgctgggattacaggcgtgagccactacgcctggcctctaatttttgtttttttggtagagatggggtttcaccatgttggccaggttggtctcgaactcctgacctcaagtgatccaccctcctcggcctcccaaagtgctgggattacaagcatgagccaccacctgcggctaatttttttgtattttttgtagagacggagtttcgtcatgttggccaggcccatttgagatctttgaagatatcctcaacgtgaggtaaaaccaaactcctgactgtcctgtgctcccaaatgtgatctccttgtccgtaaggagctgagtcccttcccttggagagaagagtgtgccctttctctagatggctaaagaaacctcacagatagttcttttttttcctttttttttttttttttttttggtagagactcagtctcactgtgttacacaggctggtctcaaactcctgagctcaggcgatcctcccgagttggcctcccagagtgctgggatcacaggtgtgagccacaaagcggattgctgctggggcttgctgttctcccgtagctcccctgcagccctgaccctctgggcccagagccctttacttgttatttgttttaatagaaacggggctcatagcagggcataggggttcacgcctgtaatcccagcactttgggaggccgcagtggcagatcgcttgaggccaggagttcaagaccagcctggcctacatggtgaaacctcgactactaaaaatacaaaaattagtcgggcgtggagtcacgtgcctatagcctcagctactcaggaggccgaagcacaagaaatgagctgagatcatgccactgcactacagcctgggtgacagagtgagactctgtctcaaaaaaaaaaaattaataaaaataaaagtaaaataaaatagaaacagggctcacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagccttccaagcagctgggattacaggcatgtgccaccatgctgggctaatttttttatttttagtagagacggggttttgccttgttggctaggctggccttgaactcctgacctcaggtgacctgcccgcttcagccttccaaagtgctgggattacaggtgtgagccactttgcctggcccacatttttattttcttttctttctttcttttctttttttttttttttttttttgagatggagtttcactcttgttgcccaggctggagtgcaatggcgcgatctcggctcactgcaacctccgcctcctgggctcaagcgattctcctgcctcagccttccaagtacctgggatcacaggcatgtgccactacacccggctaattttgtattttttagtagagacaggctttctccatgttaggctggtctcgaactgtcaacctcaggtgatccacccgcctcagcctcccaaagggatgggattacaggcgcgaaccaccgtgccccccccaacattttcattttcatctcatgaagaaaagttgatagaaaaaaagccaggtggttggtacccatgtttatataaagatcctgtcacagactccataggatgaaactcagctgtgaaatacgtgggattaaaaagagattagagtctgggcgggcagatcacaaggtcaagagatggaggccggcatggcggcccacgcctgttattccagcactgtgggaggccgaggcgggcggatcacaaggtcaagagatggaggccggcacggtggctcacacctgtcatcctagcactgtgggaggccaaggtaggcagatcacagggtcaagagatcaaggcagggtgtggtggcccacacttgtcatcccagcactgtgggaggctgaagtggatggatctcaaggtcaggagattgagaccatcctggccaacatagtgaaacgccatctctactaaaaatacaaaaattagctgggtgtgtggcgtgtgcctgtaatcccagctactggggaggctgaggcaggagaatctcttgagcctgggagacgggggttgcagtgagccaagagcaagactccatctcaaaaaacaaacaaaaaaaagattagtttaaactttttatttgaaaattctcaaaattgaatggcataggccaggcgcagtggctcacacctgtaatcccaccactttgggaggccaaggcaggcggattgcttcaggccaggtgttcgagaccagcctggccaacatggcaaaaccccgactctactaaaaatccaaaaaaattagccgggcatggtggcaggtgcctgtaatcccagcactttgggaggccgaggtggatggatcacctgaggtcaggagtttgagaccagcctggccaacatggtaaaatcccgtctctactaaaaatacaaaaaagtagccgggcatggtggtgcatgcctgtaatcccagctactcaggaggctgaggcaaaagaatcgcttgaacctgggaggcagatgttgtggtgagccaagatcgcaccattgcactccagcctgggcaacaagagtgaaactccatctcaaaaaaaaagaaaaaaagtggaaatgtttgattatgtttaggttgaaagcagagttttgcatcagcgaaatggtttttcatgagaccgaaatgagcgtaaagcagaagcaagggtcaaggttttgcccagggaggacaagaagaactccccagaggacagtggggaatggagaggacagtggggaatggggaggaccgagaagctactcactaccccaagtaaccaggcgtatttttgtagggccaggtgcatgcccatattgattgacagggtctcactgtgttgcccaagctggacgtgaactcctgggctccagccatcctactgtctcagcctcccaagtagcataccaccacactcatctgcctcctttgctttttttttttttttttttttttttttttgagatagagtcttgccctgttgctcagactggagtgcaatggcaccatctcagctcaccgcaacccccacccttctgagttcaaaggattctccggcctcagcctcccaagtagctgggattacaggcatgcaccaccacagccagctaatttgttgtatttttatttttattttttatttattttcgagacagagtctcactctgtcaccagggctggagtgcagtggcacgatcttggctcactgcaacttccgcctccctagttcaagtgattctcctgcctcagctttccgaatagctgggactacaggcgctcgccgccatgcccagctaatttttgtagttttaacagaaatggggtttcaccatgttggccaggatggtctcgatctcttgacctcgtgatccgcccacctcagcctcccaaagtgctgggattacaggcatgagccactgcgcccagcccttgttgtatttttagcagagacagggtttcaccatgttggccgggctggtcttaaaactcctgacctcaggtgatccgtccacctcggcctcccaaagtaccaggattacaggtgtgagccactgcacccgcccctgtctttgcttcttaaggtgaaattgagatgactgaatcttagtacaattttttttttttgagacagggtcttgctgtcacccaggcggcagtgcagtgtggcaaaatcatagctcactgtagccttcaattcctcagctcaagtgatcctcccacctccacctctcaagtagctgggaccacaggcatgctccacaatgcctggctaattttttatttttttattttttgtagagacagggttttgctatgttgccaaggctagtcttgaactcctgggctcaagggatctgcctgccttggcataccaaagtgctgggattacagacgtgagccaccatgcctgaacaaaactacataaatttttaattttttttgtggaaatggagtctcactatgtttcccaggctggtctcaaactcttggctctgtcctgccacagcctcccaaagtgctgggattataggtgtggcgcctggcccgtacaaatactttttattctaggcttaacttttacattggccctagctaaatagaaatctcatcactcaggaattaatcctcatttaatcaaacgggtagggtgtaatcttaggaaattattgattgactctacctgattggatttgtagttaatagctaattaggttaataactaaattcacaaggcacagttttatttgatctcttttaaattgctcttaaggatgtaacaaagagtgcgtgggatgccctgagggcaggcattcgacttctggagcagcagcttaacttctgaaattcctccgaaccatgtgtccacacctcgtctggctgcatccgtgggccagatgtgggtggtgaatcctgtggattagaggtggtgctaggtagcccccaagtgactgcagtggtgggtccacaggcagcctgcagagcccgccctgcagcatgccagctgggcctgtgatggggcatccagagggtgttgccctgaacactcagcatgtctccgctgacacagtgtgctcaggctttgttaacatggggcctgttggctgcagagactcaggagttgagagtctaatttttggacctgctgatggttaagtcatagtgagtcagtgttaacgcgcaaagcgtttgacgagtccaatgtgcttccatactaagcagcaccaggtttcttttgctaaaattgaactcctgtgaaaaattcagagtgactaagttcattcaacaaagaccgtgggagcccgaggctggtaaacaatgagtccatcccgcatcccaggggactctggtggcagtgcagttttgccgagaggagttttaatttaaaaaaatgcaatcaggagaccagcaggtcctggaatgagtcaccctcagtgcatctgcggactcatcagacaccccaggccggcttcgggtggggaatgcactagaacgaagtgacacctttgactaaacgaggcctcccccgagtactcagagtggcccagacccctctcctcagggggctagcaggcttcagctctcatttgaaagggccgatatcaagcagagttgtgctgaggccagaaacccccacgggcaggtcctcccagggctgggagtgggcatgccgtggggccggcgctgccaggacaggagggtggccacgagctccagctccacaatgccaggccgaccctgccgtggggctggggctgggacttgctgtgctctgttggcagcagctgttcctcaggggtttccaggctcttggagatcagggacactcatttctcttgatcatggctgatacaagcatccctctctgtgtcaggtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctaggtccccagaccccacccctcctgcccttgatcaagagaccagttcactactcagatgcacgtctccttggtgccttgaccattcatgtgacctttttggcatcacagatcaagtgtctgcagatgggcccagggcctgtaggtcagacattgccctttttccccagcctcaagcacaggggacacagggtgggctaggccagagcgccacctcctcagagaggcccctgggctccccactgagcatgatgagcctgggtgaggggaggcgcctgctgcggttgccccgggtggaggccgcatgtccggtgtcccttggtcattgctggtcttcgcctgggggcgggctggtcaggagaccgattgggtaacactcctgatttcggcttctctgaaacatgagaggctgcagtgctggagccactgcccagggtccctacctgcacccctgcctggcttgtcacatgctctgtgtccagcctggtcatgcctgtccttttccccacctcccctccgtaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcagg

SEQ ID NO: 692 - DNA, 8762 bp, Homo sapiens; identical to SEQ ID NO: 687

SEQ ID NO: 693 - DNA, 8762 bp, Homo sapiens; identical to SEQ ID NO: 687

SEQ ID NO: 694 - DNA, 8762 bp, Homo sapiens; identical to SEQ ID NO: 687

SEQ ID NO: 695 - DNA, 8762 bp, Homo sapiens; identical to SEQ ID NO: 687

SEQ ID NO: 696 - DNA, 8762 bp, Homo sapiens; identical to SEQ ID NO: 687

SEQ ID NO: 697 - DNA, 7749 bp, Homo sapiens
cctgcttcctgcacgggtggtccccaagcactgcggggccccagcccaaagcggaccttgactaccgcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtcatggaggagttccggcgctcctacagccgcctgtgcagggagagtggggccgagccccaggaggctgtcctgcagcagctgcaccagcttcccaggggccggctggacctggccacgcaaagcctgacggtggagacctgcagggccctgggcaagctgctgccgagggagacgctgtgcacggagctggtcctgagtgactgcatgctcagcgaggaaggtgggcaggcgcggcggggtggatccctctgctccttagctgcccacaccattgcctcggcagcccgaggtcgcttcctctccaggctctccaatttctgtgccgtagttaaagcgagcaggggcgccccttcctgcacctgggagtagagggcagttcctctgtatgacgggggagaggccttaacattcgcggtcttacctggttccccgcgtgcagagccggcttggtgcctggcaggggctgcaggtgtttcaaacatgacttcgcagcgagactcttggccagcgccaacccagaccatcgggacagttgtcccttcctgggtctagggagctgccctgaaaaggggcccacggggagggccttggggtcagcaggggcagagagtgaccgccggccccccttacacaggggccacactgctgctccgaggcctgtgtgccaacaccgtgctgcgctttctggacttaaaggtgagatacctgcactcttgagtgtccgagtgtgccacccaagggcaagaggagaggtggaagatgccaggtctcgggggcctggggtctgggcaggtggctggaagctgtctgtgagtccccaggccgctctctgatggcctcctgtgtgtgaccatctccagagcaagagttcacattggcaaacaagccggcccttggaagccccctgaagacagggagcccaggagctgaggaaggctgcagggtgcaccccaggcttgtcccctggctgaccaaggcccttggggcatgggcgggaattcagagccagtcagggcacgcgagtgactaccggcctgtttctctcctagggcaacaaccttcgggctgcaggggccgaggctctgggaaaactcctccaacagaacaagtccattcagaggtgggtggtggtcccgaccccaggccctgtctctgtgtggttgaggattggccccgagcacatgcttctgcagcccaagagttccccattgccaggtgcccatgtttcacatacgttggcaggggtaggcagaggctccggcccatcagaccccaagcccacacccgtccccaagccctggaccccacgggctaggcagtcccctaggtgaacactggcttctgcccctcctgcagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctgggtgaggcctcccaggcgccctcaggctccctcatccctctgaggctgcctctgctctgggaagtgaggggctaggggactggcctgtgctcctgctctgttgatgactgcaaggcagtgccccctagggaagcaccccggccaggccagctccccctctgccaggtgcattctgtctggtgactacaggtttccttccagacctgcgctggaataacgttggcctcctggggggccgggccctcatgaactgtctccccagcaacagaaccctgtggagactggacctggctgggaacaacatccctggagacgtcctcagagccgtgggtacggtgcagggctgtgtggagtgacgcgtgagcctttgacagaggcctgtccaccgagggcggggtgccgggctcaggacgggaactgatgaggagagcagcctgagagcccaggggaagcaggaaggagcggaggggtcgtggggcacctgtttggcacttgaatggcgttcgccacacatgggcactgtccgaggcgccctgtgtacttgctgagttcttaggacctgtgcagtggagggtgcccgtttcacagctggggaagctgaggccgtgtggctcacagtcctggccttggtggctttgctgatgcttcgggtggcccaggtcttggccttggccaggaaggctccctggtcaccctgagtctgtggccctgcatgtgagtcaggtgaggtggggccccctggcttgtgctggcctccacacattccctcccaccagcgaccccgaatccttgcagctgatgtctcagcctcaggccccagtgccccagactcagctggggactttgccaggccccccgtactccctaatccgcgcacagcggcagcctcttccagcccctgtgctgagggctcatccctcctgctggttctgcctggcctctgactccagctgcgccgtccctggcttcgcctcggcactgccctggttgttgtcatccctcctgacctctgccccctcgccacatgctacccagatctttccagaactgagctgggcacagcatttgcctcagcattgtgcagtgccccttgacctttgggatggtggccagatgccccaggatggcccttgccttttgcggtggagcagctcccaccacctctgccccacatgtgcacgcgctccccaacaccaggcggctcttgctcacagcccgaaccccacaaagcacttccacccccatgcactgagggggcacccctgacttgccgggtgagacgctgccccacacggcatagattcccaagcagccagccgctgggtgcagggctggtggccaccagctactcctgaggctaagcagccccggggtgacacagctcctttgtgtgtgtgtgtgtgtgtgtgtgtgtgtgtgtgtgactgagtttcactcagtcacccaggctggagtgcagtggcgcaatctcggctcactgcaacctccacctcccggttcaagcgattttcctgcctcagcctcccgagtacctgggattacaggtgtgcgctaccatgcccagctacttttttgtatttttagtacagatggggtttcaccatgttggccaggctggtctcgaacccctgacctcaggtgatccacccacctcgacctcccaaagtgctgggattccaggcatgagcccctgtgcccagctgacacagctccttctgcagagcaagccatgggccacagccaggaccggctcaccaccttccaggagaaccaagcccgcactcacgtcctcagcaaggaggtccagcacctccgggaggagaagtccaagcaggtgaggatggcgccttcactgaccttggagctgcttatggctggagggcctggccacgtccttcctccctcagccccgtggtctgcccatcttcccttcctcggggccctggagcctctctgagtggctggtaccaggaaggaggggcggcctcctggtctgatctgcaggtggacttccttggggagctggcgtctgagccctgaggcctcgctctgcaggggccacccttcctgtgaaggagacagggcaccgtgggtggaaccctccgctgccttgccacattggtgggcgctggctctccttccccctgagaaggtcaggtggacaggctgcaggtgccctgacagggctgcggctgtctctgtccccagttcctcgacttgatggagactattgataagcagcgagaagagatggccaagagcagcaggtgagcgggcccagggcaggggcagggtgaggcttcagggatcaggtcctggctcagactcagatgggaccaacctgagcccacgagtgaggccacgaggaggtcgctggaggctcagtgcccaggcgaccatagatgcttaaggaacagcagcagctaccgaggccagaggggtatgggagcgctctggggtttgggttactctctgcaccctcctctctgcccacagggcgtcggcagcccgtgtagggcagcttcaggaagccctgaatgagaggcactccatcatcaacgctctcaaggccaagtaagtggggggtggcctcaggatacttcagagacgtgcccacagggcagagaaaggtggtgtgaacctgtgtgcaagtcctgtttgcaaagcagaggtgggaaatggtgaggctggggcagtaacccagaagccttcctggaggaggcgggtgctggctggggttgactaggtgcccagcaacagtgaaagcagcgaggcctttataaggcaagtgaaactccaaccggggcgggggtgctgcccctcctttctgcaggctgcagatgacagaggccgccctggctctgtcggagcagaaggcccaggacctgggggagctcctggccacagcggagcaggagcagctgagcctgtcacagaggcaggccaaggagctcaagctggagcagcaggtgggtgggcagggcttgagaggggtgggccaaggggtgcgtggcggcttcgtgaccctcactacccataccccgttcccctcccaggaagctgcagagcgggagtctaaactcctcagagacttgtctgctgccaatgaaaagaacctgcttctgcaaaaccaggtagctgtggtggatggagccagggagcccagggtgggcgcggcagggctgggctgcagcttccctccctggtgccggctttcaggtagacgagttggagcggaagttcaggtgtcagcaggagcagctgttccagaccaggcaggagatgaccagcatgtcagctgagctgaagatgcgggccatccaggccgagggtgggcacgggcaggcctgctgtggaggggcctggggatgggcaccgggggacgggggcccccaggggatgctcacgcatactctgcccaccctgggcttccagagcgcctggacatggagaagagaagatgcagacagagcctggaggactccgaaagcctgcgcatcaaggaggtgccctcttcgttggcctctaatgcgcctcagtctctggtcttggtgtcacgcaggtgtccccaaagcacacacctggtgggagcttcccttgccaaccttgggtcactgggtggccgtattttgccagcctgagcggatgtcagacccagaacctcctattgggggcggcggggggaccccggcaatgtctgagccgtagtacaggctgccgttgaagagacaccaaggcccactcgttcagggtgtgcatgctgcggtagtttcctgctaggccatctgaggcagtgctttctcagaatgaacaaggttctcaagagacacctgcctttcagggtggggagtccgtgaggagaaggtagggaggcccgctctccactctggccccacaatccctgcccctgagcaggtggagcatatgacccgtcacctggaggagagtgagaaggccatgcaggagcgggtgcagaggctggaggcggcgcggctgtccctggaggaggtgagtgcccaccaggcagggccaagctctgccttagtcctgggctgaacaaggcaggggcccctggtgttcgccgcctcaggaccagagacctcttcctgttcccagaggctcataggccccaccttggggacccacccaccagtgtgcccaagaagctaaagggacttaggtggcattcggacttccttggccttaggaaccttgcccagcgagctaggtggcagagcagctgcgtggccctcaggaggctggcagagaggagcccccctggctggggttggctggatgggccagagagagaagggccctgggccagggacaggagaacgggctggcaggtggccatctgtgcaggagctgagccgagtgaaagcagcggcactcagcgagcgtggccaggctgaggaggagctgatcaaggccaagagccaggcccgcctggaggaggtgagccacacatgtccgccaccctccgggggagccaggctgcccggcattgcggcccgcatgcagactccagagcttcggtctgagtggggaggcgggagtgtggtgttgaggtcagatgagcacaccctggacactggtgggtccgcttcagccttggatcagggcctgagacggtggagaggtttggcccatctctgcagcctgtgactacacgcatggatggatgggaggggtggtgtgaccgaagagggaggaggagagcccagagggcatctggaggaggtggctgccaggggagcgggttcagagtcatagtaactagagcagccagtcctgcagagaggtggggtcgtgcccgtgcagacattccctcagctgagctcaggctgagcccctcatgcttcgtggcggcccctgtgctcacagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggtaggcggggctccggtggggggccccgggcgtgctagcccccaaccctcgcctcactccccagccttcgtgcctggcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaaggtgagccagacccttgtcctcccgccgcccactggtgggacgtgaggccagccagagagcggggctggccaggtctcccgtgctgaggccgtgccacggtgcgctggggctgcgtccgctcactgcgctccttgccctgcagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgata

SEQ ID NO: 698 - DNA, 2926 bp, Homo sapiens
catgcgcaacccgcgcgccgtcgtccctggcaacactggctgctctagcgcctggcggggtctcacgggcgggcctgggcgcacggccaaagcgccaggtctccacccccagcccccggcgtcctgcagccggagcctgcctcgcctggctcctgcgcccgccgtccagggcccctgtccaagctcgcggacgccggcggcgttttccagctcgagtgctcagcctagggcaggctctgcgtgcgccccctcgagtgccggcctgggccctgccaggcagaggcgctcttgcgtcaggacggcgccgccggggccccgcgattccaactcgggggtcccggagcggcgcggggcggggacggcctggcagctcccagcagcgaggggcgatccccgcccgcgcagcagaccccgagctgcccaggcccttcctgcgccacgtgtacccagagctccgcccgggggagacttcgctgcttgttggagatgcccagcggtagggggcgaggactcgggaggaagataaacgggggatcccgtgtctggactttctcctccaccctcttcccttcgcagctgtgaatcctgggaggggaagggtggccgccccgccagcaggtgagcggggaggaaggggcggggacgggctgtggggtcctcctgggctccgtccatgaacaggccggccccaaagtcccgaagccgtgaggtgtaaggctcagaagcgtccctccgcctgtccctgccagaccccaggaactcctccgagccccacagcacgttgtcgccgtgtgcgctgtggggctgcgtgtggttcttacggtggtgtccttagtcgtcggggacctgctccccctgctctggacacagcccgagtctcacaggctctaggggcatgatatggtcctggcgtggcttccgaggcctcaaccttagtgtacaaaacagcacacggggccctgaggccaggagtgcagctccgtctcctgcctctcctccctgctcgcgtcctcatcctaccacaccacactgggctggcgaggggagggcgccctgagccgctgggcatcctgctccgcgggagggtgaagtcgtgcattgctgggcggtgagggctaggtccacacagcggggacctggcgggcccccgagtctcctcaggacccgccctccgtgccacacagcgggagctggagccacggtgccgtcaggagccaggggtgattggccctggggctggcagcccccaccccgcgggcagacgctcaccaggctgtccccactcactcccacaccccaactcctcctcacagggtcgagcccgctctcatttgcacctccgcgcgaatttggaacggatttatgaatcgtcctcactgcggtgctgtcttctcctgggaaggagcctcagtcctcccctccctgggcactgtcatagagatgggcaggacgggctggggaggacactcagggagctgcccaggctcctttgctgcccctcaccccagaatcttcttggggtgggtggggtcccaggcacctgcagagtagcatacggtggcttgtagaaagagtatcgagggaggggaggtgccacgtggaaacagcccaagccaaacccctaggacctgtctccctgtcctcctagagagctgaaggtgttccgtggtcagtgagggctggcactggctctgcacgaagatctcctcacctccccagcggctcctggccagctccccacggagagcccaggacacttgtccctggacacagtggtgcagccatgcttgggccaaaccatgaggccaccagaaccgcgaaaggctactgtactgagagggatactgcgagagaggcccacaggtttccaagcatccctctcactccgcacactcatctccacgaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactggcccccgcaggcacctcccgggcaccctcccgccccaggctgcagcttctgtgggactgagccccgcaggcacctccccggcatcctcccgccccaggctgcaccttctgtgggactgagccccgcaggcacttccccggcatcctcccgccccaggctgcagcttctgtgggactgaccttaagaccccatcggttcctcctgagagcagcagatctcagccagatgctgccgggagggaggtgctagcgtccacacccagacgggtccagtccagccctgctctccctggtctccaggcagggccctcccagggtggacattgcccatctctgcctggccaggggctgctgacccactggttccagagtctgagcctgtcctgcacaagtaccatggacaggggtcagccgggcactgaagaggcgtggcagaattgggcagggcaagggccccagctggcaagctggagtcagggcaattccaaccaagaaactgcggcaggccgggtgcagtgtctcaagcctataatcccagcactttgggaggcagtgggagaatcgcttgagcccgggagtttgagaccagcattggtaacatagagaccctatcgctacaagaaaaaaaaaaaaaaaaagctgggcatggtggtgcacacctgttgtcccagctattcaggaggctgacgtgggaggattgcttgtgcccaggggttgcaggctgcagtgagctgtgatcataccactgcactccagcctgggcgacagagaacctctctaaaaaaaaaggaaaatgaaaaataaatgggggcagaagctgagccaagcagaggcgggcagctcctcctccagggcccacctggcctgctgggga

SEQ ID NO: 699 - DNA, 4208 bp, Homo sapiens
ctgggagagacagttttgatttattgatgttgctttgtgagaacaaatttatagcctggggaagcatcttccaaggggaatatcgcatggctggaaaggtcacacgccagctttgatgtcgggtggcaggaatgtgggcaggaggcagcgctgccagctgctgtttgtcaaacacacaggctacctgctggccaggcctttcccagcacctgcctgtaggaccccgggtggcatgcacactattgtcccagggaggagaggcagggactccccaggtgctgccccttcccacaccagtgtccccactggacactccaaggcccgcagtgcactgcagtcctgccccttctgcacaggctggagactcccagagatcttgtttgaatcaactccaaatccttcaggtccttccctgcctcttatcagaggccgctggaaacacaaggcctgcttctgtggaccaggggctcctctgggggtggcctcagccacggctgagatccctagaagtccaggagctgtggggaagagaagcacttagggccagccagccgggcacccccacttgcgccccgacccacgctcacgcaccagctgcggaagcaccttctccagctggtccacgtccacacggagcgcgtcttctgcctgggcctgccgcacgccgcggactgctgcttctgcggtgagaaacgcgagaggtgggggatgctggggggatcttaaacccgagcccagtgagggcctcagcctgggccggtgccccccccaacacccacgggcagcccccagaaccaggccacagcacctgacaaacaggctcaggagacccaagtttaggcccttgtgggaaacgggaaaacacgtcttggttttcccgctggaaaaacgcaaaattccggatgctgtgcccggagggagcgtgggccctgggctcacccacaacgaagaccttcagcaactccaccatgagctgcagcgcgtccccgctcactgcaaggcagggggaggttatgcgggaccctcacccaccgctctggctgggtgctccagacatacccccgccctcccgaggccttggccctgcagagttgcaggaaagggtccctgaggacagacacggggacccacctcccgcccgcacccccacccgcacctttggtcttgtcatccttgaagtgcaggtgcagcagcctgctcaccagctcctagaagggaggggggtgtcagcgccacgccccgccctcccccccgcaccccccagggtggtgaccattctggtgacagtggctgtgacttctggctggagacgccctctgtgcctgagcctctcccagggcaggggacaagggccagcctagtgcttcgggtggcagaagctgaagcagatgcgtgggcagctccactagggggcgccagggccctgcacagggtctgggctgggagcctccctacggcgtgagtggtcgcagacacgggagcaggccccgctgctggggctccagggagagagtggagaaaggcctcgtcgagtccggcctaatcttgcactcccatccccggcagagggccatggctctgctctccttgtggggaggcagggaaggcagagcccgggttgggtctggaggctggaggtggctgctctgcaggtgggctggcctgagggagtgccaccagtagggccttccttgtgccaactctgttctgggtgctgggtcagctccgcccgtcttgccctggtgctcatgatcctgcaggaggtgctggtgtcctgggagcgcagagcggggctgcgccagcgtggtccacaggctggagtgaggggtgggccagacgctgagggcccagggcatgatgagctctccgtgtctccatggcaggaaactgggagtcctctctaggtttttgtggaaagcagcactggcgttggaaaggaccactctggctgccatgcccggggtggggggaagggagggggctgcagagccagggcctttctgcctttctgatggatggaggacggggacaagggaggagtctacgccaagaccccaaaaggacggcactgctctgaggagatggggggccgtgggcaagtgcattttggagctaggacacaggagatcagtttgggatgcgttgtgtgtgaacacaggagtggtgggtggcagctgcagtggtggcggccgagactcaggagggcagccctgggtggctggtggagccatgagactcagtgaggtggcccaggccaggcaccggcccacagccgccgggaaaggagccagcacggagagtccaggactgggggtgggggcagtgggcacccaggagcccagaaacaggccactaaaagggcaggtgggtgaactaccagccaggccaccagcatcggccacagggaggtcacagcacctcacccagagcagtccagcaggtgacaagcagagcatggacgggtgaagccctaagatgcagatggtgaagaatgttccccagcagcgggcagcagggtccagcatcccggcttgtccagcatcccggctcgtcctgagcccttgctgttccctagccagggtcccagtcaccacccgcatgagcccagtgccacctgctggtccttccagctgcttactgccagcagtaccagaaaggcaccagaaaaggtagagaaggcactatctccccacctgctccgggacccccaacactgctgccccaggccttggaaggaagaccacgccagagagtggcggatgccaggtctgcctcgacaatccatggggcttccccgtacatcggcagtggcctcggaaggcaggcccagcactggggcggttgtggagggtgcctaggacacagccagctttgccccatgacgtgggcgccacgccagggctacgggccccccactccccgtcattctcacgctcattctctgcaatgaccacaactccagctctggccagagcccctgggcctctagttgtcaggtgggcttgatagaacacatgacctcctggggtgtgtacccagtgccccgtctccggcagtggccttttggctactttaacctggtgttctcacaaccacccagtgaggtggcccaagcctcagtgactttctctttctgaattccggcaagaatcttcaactccaccaccagagttccccacaccgacaccccccgccccccacgcctgctgccttgggtgataaagaagggcctgattcaggagaaacagaattctccctgcttctacagggctgaagtcctccctccaggatgggttcacaagggcctgagaccctcccttcccaggccacagaggcccacgaggccctgctgacatcgaggaagctcggtgccccaaccttcaggtagagcagtagaaaggttcagaaaccactctgcctgcaccgatggggtcctctgcacatggcacccccagagagctccacttccaggaacagggaagagcagggcacgccctccagcctgggcggatcctggctcagacggcctaggtctgaccctagccctgctgagtcacttaacgcccccgtgcctcagtttctccactggcaggtggggttaatccctgtcaagtgtgtgtaacgtggagcaccgaagaaaccacgcgttcctagcccagtgctggcgcccaccggggagcaaacaaaagggaaaccactgtgcctggcggctggggtaggtcctgccggctcctcgggctggacgatctcactgtccccgtcctggggcctcatctccccttaacaaaagaccccaggctcagggcgcagggcggcggcccagctcctcctctctcttcgccggcttggactccgccgtgacggcgcccacccctgcctgtttctgcagaccctctccaccttcccgcagccccggctgctccacgccccctcctaccagctgcgagacaccagcccacgagggcgcggggcgcgcggcccggccggagatggagtctgagaacgggcccaacctcaaaggcacagggggcggcgcgggggctggcgtctggccctcacagtgtcacgcgtgaggtcgggacggagcgtccgcgcctgcctagcccctgccctccggccctcaccttccggaagccggatccagctcctgctccctccatgaccgcagcctcaacgcgcgcccaccggaaccccgccccgcgcctcca

SEQ ID NO: 700 - DNA, 4701 bp, Homo sapiens
tagattacattgacattttaatcagtaaggcagatgccctccaagatgtgggcgggccttgtctaatcagttgaaggcctccactattccacccacagtaaccaccctcccacacaggcagggcctccctcctcatgtggcagacagaagtcaggacactgggggctggaaaccaacttataaaactgaaagggccaggacagaactgatagcaccctcccagggaggtcaggagcaggaggtggtggccacagaagttcaccagcagcccaaggagccctttccccaaatgtccatgggatctgcgtgcttggcagccaagaggggctgtggcccttcacgctggacttgggatgcctggaccctctggcccttctcacacgggaaggagaggtttctccctgaatggagggcagggaggggccgggagggggcgtgggatcccacctctgctgagccttcacagagggggtccttgacctttgctctcaggaaggagcccgtgccagctgatactggagtaggagtgggtgaagaccctccgggctcccgagctctagaggaaggtggtcctgacatggtttgggagcagagaagaaaggaggttgaggttggggaatccacccctgttctgggctgggaagcacttgcagaccacagagatttccagtgggaagtgatgtggcccctccctggctatgtccctggctggcccctgcgctgatcagagccacagaaagtgggccactttggggaccccctagtccccctagtgacaagagaagagaaggtggtggcaggatggtggtcaggcaggacgtgtcaatccttgcccgctggggccaggctgcgggggagcagcttggtgtggccagaaggcgacagagcggtccctgcaggggagtccagcttcaccttgtccaggatggtcttcttgatggcggctggtgacacctgctcctggtcagccatggactgcagctccctagagaggcagggagaggttggctttggagcacaagcgtgcacccaggaagagggagtgaagcccacagctcccagtgccagtcagccctgggcgatgctgtcaccctcacctcagcacctttattcccctctgccagcgacacgcccccacacagctgctgggctccttctcacctcattcgaatcagctcagcatcaccaaatctccccgcagtgccccccagacctgagttctcgtggccccaccacgggatgtgggtttacacctgtctcccctgcaggctggaggtgaggccaggcccctcgtgttcccctcactgttacagggtggcactcgcagagtctgagggtgtctggactggagagtgggcagtgtggcgagaaagacgtcctcacccaccctgcagacctgaactggggacagcggctcccagcctggctctgcctttgaccagctgtgggatcccaggcaaacagcaaactctgtctttctcttgctctttgcttctttcaccttccatggaattttccttgtgcctggatgttgctgcgtgtcctactggtctaacttaatcccacagcgagggcaggaggaaggtgggcccccacagaagtttcctaatgtggctggccaccccgccaccccactggtgtggcccctggctcaaatgacactcctagctatgacaatggtgaacctatgtggggagcacagggcacagcatccgggtccctctatggatgttccctcctcgcaggaaacggaaggtggggaggggcactgcccacagtaacccagggaacctcggggccccctgtgtcctgcgcaacactgggctggagctcaatacgtatctgctgagtgcgtgaatgagcagatgtgtgtgagagaggcctctgccatgcaaggactggagaccagggaagcgggcagcgcgggggcccaccgtgtgcggatgcaggaggcctccacagcgttgatgagcagggagcggaagcccccactctccagcacatgcaaggcatggatggtggccccaccaggagagctgacgttgtccttgagctggcctgggtgctgttctgagtgcagcagcatcttggcagccccctgcagccagaagaaaggctgacggctgtgggcacgcacctgcctctgcggggcactgccccagccactgtagcacacactgacgccccacttggctcctcccagtgaagccccagggccccgcaaagagtggccccaccagagggtcaggaaacacactgaccaggagggcctgggccccgaggcggactgccaggcgccttggaagtcccatcttcacacccccatcagccagggcatccagggctgtgaatgcctgtggggagaaggcaccctgagcctctctcctgggcttctcctccttcccttctgggcaagctccagttcccacagccttggagccctccaccctggccctcccagggggagcagggacagatgtgcccggtggtcccgggaagtgcccgccgccgccagcttcccccgcagtccttacgtaggcggggccgctgccactgagccccgtgacggcatcaatcaggtcctcttccacctccgtgcagaagcccacgctgctcagcagctgctccatgagcctcccgtcctccacctgggcgtgcgtgcctgtggcatacacggtggccccctcccgcaccacgactggagtgttggtcatgcagcggatgaccctgggggctggccgaaacgctgacagcttctggaagagaaaccagcgtgtccgtctggccatggacgcagtgcctagatgcactcaccccaccaagcagtgcccgagctctcccagtgggccgggacgctgcaacccttttgcagatgaaaactgaagtactgagggcccgggctctagacagcccctctccacaccccactgggcctgcggtgctaccttctcaatggagctgatggtgacgccggccgcgcaggacaccacaatgtgtctgtcctcaatgtcggcgcctatttcatccaggatgaaggggatgatgtgtggcttcacagccaggaagagcacatcactgtgctgcaccgtctccttgttgtggggtgtcaacttcacccccatcttctgcaggggcaacaggtgggctcagcctggtcccgtggctgtctgtacccccaccaagccaagagccccacaggtagaatggcacagagaatgctggagttgggggtgggcagggctgggggctcagggctctgaccacccccttgatgacccttcccacccagaaatggaggaagaactctgtgtggaatatgtccctgctgcagacagaaaaggaccctccatccatgccaccaatctgcccccagcctgggactgccgtcctccagaccgggctctccacgtgggagtggtggtctcaagcagcccccaggtgtgttccttggctgccaggctgtggccccacctgccaggcccccagaggacccctcgaaactttaaccctgtgcagggaactccattccagaacaacaccctcctatcagctgtacacacgcccaccacccaggtcccaagagcaatcagcagggcgaggaggtggggtccatgagaccccagcccagggcccctgccctcactggggtgggggctacagcacacactcctgcctctcacacccagccccacagagactcagtctcctttctccctttcatctgcacctaccctgagagcagaaactgtggccaggtccatgtctggggagctagccattatcttgtgggcagccaagacgcctgaggggagaaacagttcctcttcagttctttattatttttttttttttgagacggagtctcgctgtgttgcccaggctggagtgcagtggcgcaatctcggctcactgcaagctccacctcccgggttcacgccatgctcctgcctcagcctcccgagtagctgggactacaggcgcccgccaccacacccggctaatttttggtatttttagtagagacggggtttcactgtgttagccaggatggtctcgatctcctgacctcgtgatccgcccgcctcggcctcccaaagtgctgggattacaggcgtgagccaccgcgcccggccggaaacagttcctcttcatggctagctttggcttccctccctccccattcccaggaagaagagtgagacagcacaggtaaagccccaaacacacagaagttgccagttcccgcaggactcaggccttgtgacccagcacccaccttcagcccccagccctgcagaagtggaaagaggccagtctctcccactgggcctcaccgtcccccacctgggggcctacctgctgctgtgaagcccttggccagggcaaaagccagctggccagcgccgatgaagcccacgctcatgctgtccggagacccctggcccaaagcccccacagatggcaccggctctgcgggacgagaccggcaggatcgagagcaagttaggggggcagtgccagcctggccgctcctcccgcagccgggtgcccacctcccctggtcccagctggtctaactttccactttgctgtccggcccgttaactgcttcggggcccccagtcagagcggcggtgcctggcctgctgcctagggtcccgcacccactggaggggtggaggttccgcagaagaaatgact

SEQ ID NO: 701 - DNA, 9443 bp, Homo sapiens
agtctctttaaaaggtttattgatcatatacaaaataaagaaaaccttatatatcacaaacatacactatgtacagcaataaatacccggggggccaggcccagtgctgcccctcctggacaataatttagcaataaatactgcgcagggcaggggtagggcaccaaggccactgccctgcaagaggtcaggcccctgcccgccctacacgaagtgtgagcgctcgggcctcaccccgcatccaaaccccagcccctcctcacttagatctttaataacctccatcccaccccagcagatcccggggtcttctcccacacacacaacctcccctggctagacctaggcagggcaggcagggactgatcaactctgcttggacccacctctcagcgccaggagagcaacagggctggacacgcgggcagcccttgtcctgttgccaggagaaggctttctgtgcccactcccgtttggttaaaggcttcagggactagcagattgagggggtgggaagaagggcagggctgggacacaaggttgctggaggggccaaagcccaactggggtcaccaagaacagggaggtctcacagtttatcggggacacactctagctcagactcaagggacacccatggtatcaaagctgctgctccaggggcagggtggaaatgtgtgggactggcccagcaggtatggtacacacccaggacacaggccagaggcaggacaggcattagtctctcagacacgccctgcctctgtgtggcactgattatgtactctactctcccgacctgctccaaggccagacagccaacaggaaggcaaaaatacaccaaaaagaattattcagtggcttctgggggaaaaatcgttaatgtgttggttcctttcaccaaaccacagcctaaaaaagtaactcacaagatcccagagcggaaacggtgcagcaggctgcggctccgactttccagatgtggatgggcgctttggccaagtggccactccagagggaggcagcagggacaacatgggacctgaccatcgtcccaaagcaggctgcagccgctcagggccgtgggccgggccctgatcaccagtcagaagtgtacacacatatctgaaacatgcaccaagagctgagccagcaacaccagtgccaccccgagcagcagccaggggcctcactctcctggtgagagctgacctgtccctgctgggtattcctctgaaatctgagcgtccatgttaggataaaagaggagttggggcaaagttaaggtggaagggaagacatatatcatggtttacttggcggacaagtttgagagacctggccttggccaaagccctcgattcgctgtgtcagaaaaactgaggtgagaagagaccaccaccctctccaccaccctctcagtaggaaagcgggatcaacagagatcagaaggacagcacactcacacctgcacatgaacacaccatctatgtcaggaaatccaggggaaggggaagaggggtggagtggctccgcagggctgacctgacaggggacaggaacactcccctagacccagggaagtcgccccaaatccaaagctcttgaaaggaggtatggcctcgaaactccagaagcctcttctgccaacgcaccgaggacctgcacctcccattcagcacgcgtcgacccttacaccctcctcttccacactcccttcgcctccaggtctgcagcctggcagaggtgctcaaaatggatggccacccacagccaggacaaaagtgggggctgcacaaggacaaggagggcctgtttctccccactccgaggcagatcatgacgttttcttcatggatacttatgatatgattccaactaacgcctggattctacttagacaagatcagactgaggggagggggatgaagtcactaaatgacaagagtcaacagccaatatttccattttcaggctgacgcaggtagacacaggacttgtctctgaacacctcgagcaaagaaaagctcattaacatgacaagtgttgatggtgcctccctgttcccatcctgtgggcacaccaggccaaactattggataaaaatcccaccatccatagggttaagccctgttgggccacagtttttcatcttacccacatctgtgtgctttacagaagtctgggccccacagaaaagaaaccagcaacccggtgaaaggccagggctcacatggccagacacagggctgtagcctcttggaggtgggtaggggcaccccctccccatcatatgcctacaaggagcctcctgagcccagccaggaagggcagcagcctctggcgaggaactgagagcaggaggcaggctgcgcccccacagggaggcacctccagcagaagccaagcagctgatccctggaagacacagatcccaaagggaggcagaaggcaggcccgaagccaagagctgccagcgtggaccagcggagaagagggacaagacccggccctggagactgtagcccttgtctgcactggtggagacccccaaggctctcagagtgaggcagggacaaggaagaaagggcggtgcccggtgggcccccacccactctgcctggaagcaccacccgcagcatggaaacacctcagggatcaagcgggcggcgagacctgcagcccacggcgcgggcagcctataggaacaaagctgaggccagaggaagacggccagggaacgcttggccatagccctgtggccacccacagtgactccctcatccctgtaatgccaccacccaaggccagaggtggtgggtgtggaagcagcgtggggcgccccaagggaccccagtttcacctaccccgccactagatcagcccaagccctagacacagatgtagccaaggctcagtggaggggggcatgacagaaccccatgtctcacctcctacggaccaggagctggtggtgggcacagattccttgagctctgacgcagcaggcgccacttggcaccccagcccaggtccagcaagccagcagaagcaaaagcacaactaaacccaaaaaacgaacacgggaaaacagacacaagaagtgacacccacaggtcaaaggtcaccagaagcaccagcactttaccgctgcacaaaacctcaccaggcacggacgacaccacggcaccggcaagagacggaagcaggaagggcagaggagtaagtcactttcggtacaattgcaaaagatatcaaagaggacggccttctggtcggctcacggcttggcttttttttttttgtcttttttttaaactaagttttataaataatgtctgataactctgtgtatataaaaactaaactccaacagccacaaagaggtgtccgtaagtttacaagaaagggattttttttctttttttttcttttttttttaactagcaaagtttctattatactttcttcccttttccattcatatggtcaaatggtcttcttgcttgttttttttctaaaagacagttttataaatactctgcagctcttttttctttaacttttaaacatataattaatttaataactttgtaaaaggaacttctctcttttaaataaagggctatataaccacacaaataggtcatgtaaacagtgacacgggacccatcgcagggcacactggacccaccctcacgttaagcgcacaaccagcgatttggtcttgttcagtgcaacgggtcaggcctgagtgcacagcccctgggcccagctgcacgcccccagcaccactgcgcccaggctggtggtccacccatcagggccttcaagcccgccctactctcagagcagagcccatctcttcatgctgggctaagctgagctgctcccctggggctaaagagagtgaatccttcccagcccgcgagcctgtggccactcgggagtggagggaacactgggaccctcactgctcggggacacgcgaggcccagcgtgcctgctccttctctctcccgcaactctctctagtccgttcccacagcaccaactctggactccaagcctgcatggccctggtacaaaaggggttggggcgaccccacgtcaccgccgaactgaccaatcccaacatacaaaacacacgacgacaatgacgagatcaaaggggctcagcccggcgcccctggggtacaggttgtgctttgcagggaagagagaagggtggggaagagagggaggaaagagaagagaaggaaacagagggacagggcagccaaattcgccatgtgcctagtggccccgcaaagacccgcctgggcagacgcgcgtccctacgatcgggcatccgtcttggactttactattgtgatgacgctggtggcggccaccttgcctgggacgaggggccccaggccggcggcaagggggccccgggctggcgccacggggctgcgggccaccgtccgggcgaaggtctgcagcgcctcgtacttggagcgcagcgcgtcgagctccagcttcatgctggcgttctctgaggccagcttctccacctcctgctgcagctccgccttctgcttctccagctcctccttctgcgtcacccgcttcacgcggcagctggcagcgtagccgcggttcttgagcgtgcgccggcgctgcttcagctggacgatctcctccttggacaggccccgcaggtgctggttcagctcccgcaccgacatggtcaccagctcctcatccgtcaggctggtgccattctcacccggctcccgcttcacctggggcacagtgcaggtggtcacaggccaagcgggcacgcccactgtgccccccgaccccagcccacaggctcctgtccctgcccactcaccttcaaggccttgtttcctttattgggggtcgtcataacccgggggcacagcgagcaggcgctctctgcaagacacggagcaggtcagtaccctggagaccaccctcgccgcaccccccccccccccgcccccggcccagttcacaagagcccttgccgcacagcccgccccagcctgctgtccaggtgcccagcccccaatacctgataggaggcagcccttggcctctcccaggctgggctgagctgcttcctgtccaccctgcccctagagaaccaggtgggaggtcaggaaggtctgacgggagaaggggaactgaaggctgttaggaaggcaggcgcaagacaaggggcgggggagagattagaaggaataagacgcgggagaggcaggcctagaaggaagccgggagctttaaaaataaccccggcactgcccagagcgcggctgttcctggcgagtcacgctgactcagcacattgcctctgcctccccgccgcgcccgcactccctggcccgccagccaacagcgccccacgagagccgcagcccccagcctggccaatagcaggtgagggccagccagtgaccctgtgtgtgcatcttccagggtcctaccttctacagccacctcccctgagccggcctcggacaaagccccctgctccctgggtgcacaggggccccacgggggacctggccagagaggaggctacagggaaccccgagtctcccagcctcctaactttgaaaagctgggggtgggccgtccatctagctctggtctgttggcaggactgaccagggagttcccccaccttccaggtggcaggccatcagctgggaggagcctggcccgaggcccctctagacctcccagtcggcctcctccactgatggagtaaccatcctgtggctttgggttgcaggaagcagcccctgccccaccccatccagggtatttcacaagggctcccacagtgagccaccccgggcctgcccaacgtgaaggctggcggagtcagcccctccgagctgcagcctgctctctggtccctgccccgggtgagtgcccacagggccagggagcaaaaacaaaagtgctggggtggccggacttaacaaccaactcttccccactcggggtccctccagcactctgctctcactttcttgctaaggatgtttctgggattcccagctcagcccagctcccaccagacccttgggcatggacccccgcctcatgctccatcccccactttccaggtttgatgcagacagatgggagactcctccagaggagctaggatcacttcaggaaattatgggctggggggcttcttactctcatcaggggagctgaagtgtggccaggcggatgcacacatcctcaccaggctcaagactccacctcacccagcctgggaccaggaggtgaggctgcaagcacagagcagggaggggaggccagagacccctccccacagccaagccagctcagaggcaaggtcccgaggctccagccactggattcttccagataaaggatggggaagacctgagctggaggtcagaaggcccacaggagccctttcctacacgtccggcacaacactgccccaggagacaggccctcagccaagcatggaggggccccccagccttgagtgcaagtcagggtgcagagacactgccctggcaccagcttctcccacccccatcgcccccacccctgctgctaagcacaatgacagtggtgacttcctgaagagatcacacggaaaagtgcctcctcgacagattttgccctccgcagaaggcctgaactcagcacaagtgcaagccatcgcctcctatcaaaggtgcgccggggggtgggggaggggcagccctgagcacagccagtgcgttccaggctcctggcctggcctctggacctgggctgagagggaccatgcagggatcccaggagctggactgaggagaagctgcccccgccctcctccagccctcaaggctgggcagagctggggcctgtcatgcaccctctgctcccagaggctaataagcccacctcacgcaggaggcacagatggtcacggctccgcaacctgcgagggtacctaggccacccattcacactgagagccaggaaagggagggagatttgggagctccgtctcctttggctaaagtagaaactcccgtgcctgaacacagacagccccacctggctgcaaagcccagcggccgaaactccccggcagtcatggcctctgctccataagctctcagctcctgaaagtcactctttgaacagaacctaaaacttagtttccactgatgcataagtgactgagaagatgtacataaatgggccgcgcggtggctcacacctgtaatcccaacactttgggaggccgaggtgggtggattacgaggtcaggagatcgagaccatcctggctaacacggtgaaaccccgtctctactaaaaatacaaaaaaatagccgggcgtcgtggtgggcgcctgtagtcccagctactcgggaggctgaggcaggagaacggcgtgaacctgggaggcagagcttgcagtgagctgagatcgcgccactgcactccagcctgggcaaaagagtgagactccgtctcaaaaaaaaaaaaaaaaaaagatgtacataaatgtccctccaggaccccaaaattttcccagggcatcaaactccaggccaacggtcagctaaaacattgaaacatctggaatctataagccccggggctcactgagagtggacctgtgttctgtgtgtatgtgtggggggtgctcactgagaatggacctgtgtgtgtgtgtgtgtgtgtgtgtgtgtggcggggggcggggggcatccctgagggcaaaccacaaagtagcctaacccagccatgaaatgaactcctgggcaaaggaagtcaaccttcgtgaatctccacatacccaaggaaaggtggctctggccacatcactcccaagctgccactttctaagcgtcctgggctgccaggccagacacccaacagggccactccctttgctaacttcacacaacgctgagaccccacttcaggtagcgacaactttagggtggctgggtgctgcgttctgccaccctgtgccatccacaccagcccatctgctgcaccccaaggctaggcaccctgaagctcccaccacctacagtctcaacccagactccagggccaactggggagagaggctgggctgcttcctcccctttgccgtttcctggtagagctgcccctgcttcctccctgcccagcccactgtcacccagggcttggtacacacacccctctttctcccaggacctcgatctctggccaggggctgtccaaccaggccagtcccagggaaagccgacttcccctttggctagctcggcccaccgaagctcctcccctccctcactcagggaactatttcccagtttggaaaactgctccagacttgggaccaggaccagctgccggaaaagagccgcctgggaaggggtggaccgcccggggcttcacctttgaccccgggagaacacctgcagcgagccacccccacttcctcttcaagcacccctgccttcaactggatcgctcggcgctcacttaaacaggcaccccaaggcgccgggcctggccccctcccacatccccacggctccctcccacctcccgctggcggccttttagtccccgaggcccctcgctcgaatcccctccggtatcagcttgagcaccgagtgacctcacgctgatgactcagcaagtctccctccgggctctggcacgcgactgacggaacccgagccccagccaggggcagggtcttccccgcagcacccccatcgccgcccctcctcccgggctcgccgcggacccccgcgccggggagagctgacgcggccaccggatgaatcagcagctgcgggccgggccgccgggccctggcgcggacccccgggcgcctcgctcgaccccaccctttcctcccgccgtccagtgcccctccctccaggacgcccgggtctccgagtccgctccgcactcgcccggctccgcgggtccgccgccgcccgcggcccacctccagtacccgggcgccaggggcaggaggagctggctcctgaccgctggggaaatcgaggcacgggccgccagcagggtgcgcggcagacccgaaaccagcggcccccgccgccgggcccccaaccgcccgcctagctccgggaggagccctgcctgcgcgccccctcggcccccgccgcccccgccgcgccgcccccaccgcccgggcccgccgccgcagccgcactcaccacactgcgggcccggcgggccgaggccggggcggggcggggccgcgcgcgctccgaggccgcgcggggcagggaccggcgcgaggggtccgggcccggggctcggaggactcgccgcctgcgcgggccgggccgagcgcactgggaaggccgggccggaccaggctcgggatccgccgccgcc

SEQ ID NO: 702 - DNA, 1818 bp, Homo sapiens
ctgggcagcagaatcaggtttattggagggattgggggtaggatgagcacggcatggggcttgaggtgtgtggagggagctcagcaggcccagaagcccccttccaccggcaaagtggaacccgtggtcatgccacttcggtcactcagcagaaagaggatggcgttcaccacgtgctctacctctgtgggcagggcgggggtcaggggcatagaggaaggaggctgccgcccatctttccctcccacccctacccagggcacacacagggactgctggcaccacgctggctgggctcccacctgactcaccagcaaacttgccaagtgggattcggttcagcatagtcttggccttgtgggggtcactccaggtggcctggcccatggacgtcatcaccactgtggggtttactgcattcactcggatctacaccgggacagctggggtcagcagggcaagtggggtgtcctaggttgggggaggtaccccagccctgctcaccttgtggggcccgagctctagggccatcaccttggtcagcatgtccagggcacccttggtggagcctacgaagaggaacccaagctggctggggctggggtcggtgatgagggcgaggctggggctggggtggggctgagggcacagctggggcactcacagtagacgctatggttagttactgcccgctgggagcactggctggagacattcacgatggcccctgggactccccgggctattaagcccctggccacaatctggaatcgcagcgagaccgtgaggcagagctggcatcactcacgagaattcccgtccagcccacagggcagctcacctgcgacacctggatgaccgcacgcaggttcacctcaaaggatctagaggccgagggacagaccctggtcagagattagggctgctgcgtcctccaggacagcccctccctgaggttcctccgccctcacaggctcacctgtcaaaggcctccttggtgacctccaggaagggctgcagcagggcgacagcggcgttgttcaccagcaggtccacggggcccacgctgcccagcgcccgctcggtggcctcccagtcacccaggtccacgcacacgggttctatccccgggcactgtgtgtatcagggggcagttaccagaggctctgtgcccagcaagcggcacagctggggactggggctggtgacctttcagccggacaagtaaaggagttaggagttccgaaggtgtcgggactgtggggccagcagccgggcgctacctccggccggttcacttcctccctgcgcccgagcgactcctgcccggggcctgcttcgcagccatttcggcctctttctgagcccgggggccccggcggctctgccgaccacccggccgcccacgcaggccaccagccccgagagagggtgcgcgggcgcccaggccgcggtgagaagcgcagcgcccgcgaggggaggcggagtcgcgcacagaggtaccgcccccgctcgctgccgccccctcctggctcgccgcctcgcagcgctgggacccggcgggacctacctcgcggacaaggctgtcaagatccgcctgagtccggctcacagccaccacccgcgcgcccgtcgcgtgcagcgcctggaccgtgccgcgccctatacctgccgggagcgggctcagtgaaggcgtcccctgcccgcctctgcccgccgccggcctttgcccacctttccccgccgcccacctttgcctgccccggtgaccagcacccggcggcccgcgaggaacagctccatgtcggcgcagtctcc

SEQ ID NO: 703 - DNA, 4703 bp, Homo sapiens
attagattacattgacattttaatcagtaaggcagatgccctccaagatgtgggcgggccttgtctaatcagttgaaggcctccactattccacccacagtaaccaccctcccacacaggcagggcctccctcctcatgtggcagacagaagtcaggacactgggggctggaaaccaacttataaaactgaaagggccaggacagaactgatagcaccctcccagggaggtcaggagcaggaggtggtggccacagaagttcaccagcagcccaaggagccctttccccaaatgtccatgggatctgcgtgcttggcagccaagaggggctgtggcccttcacgctggacttgggatgcctggaccctctggcccttctcacacgggaaggagaggtttctccctgaatggagggcagggaggggccgggagggggcgtgggatcccacctctgctgagccttcacagagggggtccttgacctttgctctcaggaaggagcccgtgccagctgatactggagtaggagtgggtgaagaccctccgggctcccgagctctagaggaaggtggtcctgacatggtttgggagcagagaagaaaggaggttgaggttggggaatccacccctgttctgggctgggaagcacttgcagaccacagagatttccagtgggaagtgatgtggcccctccctggctatgtccctggctggcccctgcgctgatcagagccacagaaagtgggccactttggggaccccctagtccccctagtgacaagagaagagaaggtggtggcaggatggtggtcaggcaggacgtgtcaatccttgcccgctggggccaggctgcgggggagcagcttggtgtggccagaaggcgacagagcggtccctgcaggggagtccagcttcaccttgtccaggatggtcttcttgatggcggctggtgacacctgctcctggtcagccatggactgcagctccctagagaggcagggagaggttggctttggagcacaagcgtgcacccaggaagagggagtgaagcccacagctcccagtgccagtcagccctgggcgatgctgtcaccctcacctcagcacctttattcccctctgccagcgacacgcccccacacagctgctgggctccttctcacctcattcgaatcagctcagcatcaccaaatctccccgcagtgccccccagacctgagttctcgtggccccaccacgggatgtgggtttacacctgtctcccctgcaggctggaggtgaggccaggcccctcgtgttcccctcactgttacagggtggcactcgcagagtctgagggtgtctggactggagagtgggcagtgtggcgagaaagacgtcctcacccaccctgcagacctgaactggggacagcggctcccagcctggctctgcctttgaccagctgtgggatcccaggcaaacagcaaactctgtctttctcttgctctttgcttctttcaccttccatggaattttccttgtgcctggatgttgctgcgtgtcctactggtctaacttaatcccacagcgagggcaggaggaaggtgggcccccacagaagtttcctaatgtggctggccaccccgccaccccactggtgtggcccctggctcaaatgacactcctagctatgacaatggtgaacctatgtggggagcacagggcacagcatccgggtccctctatggatgttccctcctcgcaggaaacggaaggtggggaggggcactgcccacagtaacccagggaacctcggggccccctgtgtcctgcgcaacactgggctggagctcaatacgtatctgctgagtgcgtgaatgagcagatgtgtgtgagagaggcctctgccatgcaaggactggagaccagggaagcgggcagcgcgggggcccaccgtgtgcggatgcaggaggcctccacagcgttgatgagcagggagcggaagcccccactctccagcacatgcaaggcatggatggtggccccaccaggagagctgacgttgtccttgagctggcctgggtgctgttctgagtgcagcagcatcttggcagccccctgcagccagaagaaaggctgacggctgtgggcacgcacctgcctctgcggggcactgccccagccactgtagcacacactgacgccccacttggctcctcccagtgaagccccagggccccgcaaagagtggccccaccagagggtcaggaaacacactgaccaggagggcctgggccccgaggcggactgccaggcgccttggaagtcccatcttcacacccccatcagccagggcatccagggctgtgaatgcctgtggggagaaggcaccctgagcctctctcctgggcttctcctccttcccttctgggcaagctccagttcccacagccttggagccctccaccctggccctcccagggggagcagggacagatgtgcccggtggtcccgggaagtgcccgccgccgccagcttcccccgcagtccttacgtaggcggggccgctgccactgagccccgtgacggcatcaatcaggtcctcttccacctccgtgcagaagcccacgctgctcagcagctgctccatgagcctcccgtcctccacctgggcgtgcgtgcctgtggcatacacggtggccccctcccgcaccacgactggagtgttggtcatgcagcggatgaccctgggggctggccgaaacgctgacagcttctggaagagaaaccagcgtgtccgtctggccatggacgcagtgcctagatgcactcaccccaccaagcagtgcccgagctctcccagtgggccgggacgctgcaacccttttgcagatgaaaactgaagtactgagggcccgggctctagacagcccctctccacaccccactgggcctgcggtgctaccttctcaatggagctgatggtgacgccggccgcgcaggacaccacaatgtgtctgtcctcaatgtcggcgcctatttcatccaggatgaaggggatgatgtgtggcttcacagccaggaagagcacatcactgtgctgcaccgtctccttgttgtggggtgtcaacttcacccccatcttctgcaggggcaacaggtgggctcagcctggtcccgtggctgtctgtacccccaccaagccaagagccccacaggtagaatggcacagagaatgctggagttgggggtgggcagggctgggggctcagggctctgaccacccccttgatgacccttcccacccagaaatggaggaagaactctgtgtggaatatgtccctgctgcagacagaaaaggaccctccatccatgccaccaatctgcccccagcctgggactgccgtcctccagaccgggctctccacgtgggagtggtggtctcaagcagcccccaggtgtgttccttggctgccaggctgtggccccacctgccaggcccccagaggacccctcgaaactttaaccctgtgcagggaactccattccagaacaacaccctcctatcagctgtacacacgcccaccacccaggtcccaagagcaatcagcagggcgaggaggtggggtccatgagaccccagcccagggcccctgccctcactggggtgggggctacagcacacactcctgcctctcacacccagccccacagagactcagtctcctttctccctttcatctgcacctaccctgagagcagaaactgtggccaggtccatgtctggggagctagccattatcttgtgggcagccaagacgcctgaggggagaaacagttcctcttcagttctttattatttttttttttttgagacggagtctcgctgtgttgcccaggctggagtgcagtggcgcaatctcggctcactgcaagctccacctcccgggttcacgccatgctcctgcctcagcctcccgagtagctgggactacaggcgcccgccaccacacccggctaatttttggtatttttagtagagacggggtttcactgtgttagccaggatggtctcgatctcctgacctcgtgatccgcccgcctcggcctcccaaagtgctgggattacaggcgtgagccaccgcgcccggccggaaacagttcctcttcatggctagctttggcttccctccctccccattcccaggaagaagagtgagacagcacaggtaaagccccaaacacacagaagttgccagttcccgcaggactcaggccttgtgacccagcacccaccttcagcccccagccctgcagaagtggaaagaggccagtctctcccactgggcctcaccgtcccccacctgggggcctacctgctgctgtgaagcccttggccagggcaaaagccagctggccagcgccgatgaagcccacgctcatgctgtccggagacccctggcccaaagcccccacagatggcaccggctctgcgggacgagaccggcaggatcgagagcaagttaggggggcagtgccagcctggccgctcctcccgcagccgggtgcccacctcccctggtcccagctggtctaactttccactttgctgtccggcccgttaactgcttcggggcccccagtcagagcggcggtgcctggcctgctgcctagggtcccgcacccactggaggggtggaggttccgcagaagaaatgact

SEQ ID NO: 704 - DNA, 4208 bp, Homo sapiens; identical to SEQ ID NO: 699

SEQ ID NO: 705 - DNA, 8676 bp, Homo sapiens
gtgaggttcttttttgtctctttaaaatcatttttaaaaagttacaaaacaatatcattcatcatatattcttattttcctttttttaaaaaattaaagtaataaaaaagtcactttataaaataatataaaagggcttgatgggtggggccggtgggtgctgtctgagctggtggactgaggaatccagtgcttctcttctggctaccccctcgttgtcaggaaggacccccaggccacagatggggatgacagcaggtcccttgtctctggctgggctgtgggagaggggcagggaaagccggggcaggagggcagtgggcagacccagacaggggggacggctggggccctgtcccgaagagacgggagggcctgctggtggggggtgaggtggcactggggcagcgggtgtctgggcccctcagtgccggctcctcctccagacagtctgcctagcttccgttgctcagcatccccagcagctcactgggctccagtccctgcggctgggccaccgtctgcatgtcgaagcccatgtgcatgaggaactgggccacgttcatctcttgccccgtgaactggtctcggacggtggggcatgaggggttgcagtggggccaggggcagctgtccaccaggtggacggggcagcccttgaggggggtcttgctggccttgtggctgtcatggaggctcctgtcccagcagtgcagtgctcggggcagcgacgtccccttcacctggacatccgtccagtggctgcagaggaaaaccgggggagggggtcacatgtgcggagtggcatcaacactgaggcagctgtttttttttttgagaccagccatggcaggatctcggctcactgcagcctccgcctcccgggttcaagcgattctcctgcctcagcctcccgagtagctgggattacaggcgtgtgccaccgagactggctaattttttgtattttcagtagagatggggtttcactatgttggccaagctggtctcgaactgacgtcaggtgatctgcccccattggcctcccaaagtgctgagataacaggcgtgagccaccgtatctagcctgggtttttttgttttgttttgttttttgagacaaggtctccctctgcctgtcaggctagaatgcagtggtgtgatcactgctcactgcagcctcaacctcctgagttcaagtgatcctcccacctcagcctcctgagtagctgggattacaggtgtgagccactgctcagcctgagtctttttttttttttcttttttttttgagatggagtttcactcttgttgcccccaggatggagtgcaatgttgcaatctcgactcaccataacctctgtctcccaggttcaagcgattctcctgcctcagcctccggagtagctggattacaggcacccgccaccacgcccagctaattgtatttttactagagacagggtttcactatattggccaggctggtgtcgaactcctgacctcaggtgatccacctgcctcaacctcccaaagtgctgggattacaggcgtgagccaccgcacccagcctgagtcttaattcttgccatacagctgttggtacaagtggctctggcacccctataaggaaatcccacccctagaagcgccaagaagaggcccatgggaggccaagtgcggttggggagcatgtggacttttgaagttgatgtcatggacgcaagctgcccggagcagggacactgacctccggatgatgatctcatgggagaggcaggcgggggcaaagctggccctgttggagaggagacagtggcttgtgagctccttaccccctcagccccttttccacccccactcccctagagctgtcccccgcctggccatcaccccttcctgttgctatggctgccagctgttcctctggcccgggcctccccctagttggccagctcccggctgacccttatcgctttgtgcctcaaatccctgctcagagtccacctcttccaggcaggccctcccaggtgatggcaagaggctgccctagacaggcaaatattctgctactatctagaactctattttcattttattttgagtcggggtctggctctatcgccccagctggagtgtagtggtacaatcgaagcttgcttgcctcccacaggcaaggttagctcactgtaaccttgaactcctgggctcaagggatcctcctgcctcagcctcctgagtagctgggattacaggtgatgccaccatgcctggataatttctgtatgtgcagtagagacacggtttcaccatgttgccctggctggtcttagactcctggcctccagcaatcctgctgcctcggcctcccaaaggggtgggattataggcgtgagccagtgtgccaggcccaagaccgatctcgatctctctctctctctctctctctctctcctctctctctttctctctctctctatatatgtattttttgagacagagtcttactccgtcacccaggctggagtgcagtggcacaatctcagctcactgcaacctccacctcccagttcaagtgattctcctgcctcagcctcttgagtagctgggattacaggcgcctgccactacaccggactaattttttgcatattttgtggagatagggttttgccatgttggccaggctggtctcgcactcctgacctcaggtgatccacctgcatgggcctcccaaagtgctgggattataggtgtgagtcactgcgcccggcctacaagacctctatttttttttgttctggtttttcttcttttgttttctcaggacctctatttttaaataaggagggagctacccggcgtggggctcccggggcccacacactcacggcacgtccttgagtgtgtggcgcagctcgcggccgaggttctggatgtacagccgcaggccctcctgcaccggctgccccgtcaggtgcacgttgtccaccgtcagctgtgcctcgtcaaacagccactgcaccacgaacacagggcctgcgggcggcggggctcagttcggcctcccctgacccccgctgctgcccccaccccaggctcacagctcagcacccccaggcccctgcagtgcccccaccccaggctcagagctcagcacccccaggcccctgcagtgccccccaccccaggctcagagctcagcacccccaggcccctgcagtgccccccaccccaggctcagagttcagcacccccaggcccctgcagtgtcccccaccccaggctcagagctcagcacccccaggcccctgcagtgccccccatcccaggctcagagctcagcaccccccaggcccctgcagtgccccctatcccaggctcagagctcagcacccccaggtccccgctgctgcccccgaccccaggcagagctcagcaccctcccaggccccctgcagtgctgctgaggctcacaggccagctagccttggcccaactctccccaggggtgtcagtcataggcccccacagaatgtggcttccttctttcaaaccagcctttttataatccacagcttcataactaaatcaataactaaatcaacaactaaatcaataaactgcctttccttgaagacgggctctgtttaacccctccatgaccttggcctggttctcagcgactccactttcacctaaatatggtgatgatgcccttgcatataacctcaccattcctcagagcgtggggctggggaggaactagcccaggaccctgcagcagggaggggcagcatggggatgagctccaaagcacactagccaccggtataggcagggtgaccacctgtcccactttgcctgggactgaggggtgtcagtgctgagggcaggcaagtcccaggcatgccgcagcgactaggccccctggcacacagccggcctcctccctggtacacagccggcctcctccctggtacacagccggcctcctccctggtacacagccggactcctccctggaccagggccgtggtctccaagcccagcccagaagactggagtccacgctggattttcagaagcaaggaagtgtggccacccctgctgccctgtgtgctccgctctgccgcccactcacagcgcagggtcgggtagaccttgtagccaaagaagcagttccactcctcgccctcctggaactggcgtcggcagcgctccgggaccaccccgttccagtacctggagccacagccacaggttaggctgccgtgggtctcgtcccccggggctccccacccacagatgccactccacccaggcccttctggggcaaagctgcagcacgaggacgggccctccccgctgcggcacctgatgccacggcggatggcctccgtgggcgcgcacgtgatcgtgtcgacgcagtctgtgtggcgatactgcttgttgtccaggaaccagccggagtcagccaggcctcgcacctggatggctgggtagcccagcttctccagctgctcagccacacggtccacattcaggagcaccccggtgccccccgcgctgcaaggagggccagacgtgaggccaggtggctgggaagaggcactcacctcccccgagtctgctcagcgtcagcccgtgccccgaggggggcaggagtcctgatgcgttctgaactgcggatgcattctgcattctctgttcacgtgcaagacccatggccgtcccctccagagcaggccagggctcaggctggcaggccacatttccctgacacagccaggctctccccttcctcctccccttcctctctctgtctctttacctcaggttccttatctgaaaatgaagataaactatgtggcctcaggccccatcatctattccccatttgtctcctggtctcctgtatgcctgctgggatacaggaacccacaggggtgatcctcatctaccgggccctggagaaggagcattagtccatggccaacccctaaccaacgacttaggtccctgcagcccaaaccttcccctatatccaacaaccatggcgtccagaagcatcctctggacagtgtctggttacccagcactctgaagccaggcctcagagacgtctccaatgatgcgggttctcccagctccagcctctcaccctcctagccacctgccaagatctgcacaggctccactccatcctcgcctctcatacaaccccaccccacaccccttccatgcaccctgcacaccgtcctcacccctcacctccagccctgccccgccctgcccacctgctcccggccagcagcagcaccttggccccgctcagccctctgcccagaagctcccgcaccacctcctggatgatgagggcgcccatgaaggcgtactcgtctgcaagagggagggggtggcctcaggtaggggcctggacagagagaaccacctcctaccccagaatggctggcagagaagttcttgccccactgggggactgggaggaatcttctgagaaggggtcaggggcttgggtggactggaggaaggcgggtgcaccaggccatgctggggcctcctccccagggaatattcagaaataaggacctcctacagttgtggacaagcaggcagtgggagcatggggcaggcaccctgggacatactgtcaagggctttgaaagcacgacaaggctgagagtcagcttttccccagaacccctgccgtcccgcctcatccctgccctgccgtcctgcctcctccctgccctgccatccggccccgtccctgccctgccatgccctgggaaggccgagactcactcttctcagacttggatgaagccccgctccaaacatcactggagcagtaggggatgaagctgcaacacagaacagagtgagcctgtcacagcgcctgccgcccggcagcctccagaaaggacccccagaacaggaccctcagaaaagaccatcccaggacaggattcccctggaaggaccatcccaggatagaacttcccctcaagaaagacctccagcgtaatactcctcaggaagaaccaacccaggacaggaccctttccaggaaagaccaactcaggacaggaccccccaggaaagaaggaccatcccaggacaggatccccctggaaggaccatcccaggagaggaccctgccaggaaggaccatctcaggatagacccctccccaccaggaaggaccatcccaggacaggacctcctccccaccacgaaagaaacacctccagaacccctctaggacaggacctccccaaaagaaccatccagaacaggacccccaggaaagaccatttcagaatatgacttcccaaggaaggaccccccgggaagaaccaccctccaggcaggactcccaggcaagaccctgtgcccccttacaccatgtttgcgttccaccagtaggggttctcctccggctgtgaggacaggatccctgtgcctggggacacagaggcggtgggtctttctagcgggaggaggctgtgtagggtcgggtctgggaaccctggtgaggtgttggggctcctacttggccccaggaagggaggtgtgctggtgttgctagcccgaaccaaggttgccgggaaagtggaggacagttgggtttagttacccccgggaagccaccatggccacggtgcccggctaggctggacaccaggtctgaccttgacttcaaccccttgccctgctttgaccctggggagggccagagccgctgggtaagcgcctgaatgctaatgtggaatgggccccaaaaggcaagagtgaagggcgccccttgctcttagtaaacccgggcgccaggctgggcatgatgtgcggggtgggggcctggctggggctccaggaggcgggcgcggcttcctcccgggcctcacgtcgagacgccttccccagggcccgccgctgacctgtgcgagtgcgcggccagtcccgggagctcatgaggcgccgcatggtgtcgtatctggagtcgcagttctcgcggttgaagcagtaccagccgcctgcggacacgaccgccgctcaggcccgcgcgcacagacccccggcctccccccgcctcagccctggacgcaccttccaggaagaggagccaccgccggctgcccctggactccttcaggtagtagctgcgggggaggacgcaccgcggggggtcggccagggctgccgacccgccgcgccccgcgcgcccagctccggcggagggaacgcgccacctgttccggccgcgcgcgacggtcgcacgggggcgccctcggccaggcccacggggagctcagggacggcggcggtcccgggaggtggcgctcgcggggcggggaacgggccgcgcggggctgtggtccgtggaaaatccccacgttccgcccggcgcgggtcccgctgtcacctcggcgcgggcggcggtcctcccggggcgcgcggcggcgcttgaagcgtgaaacgcgtccgcactgaaggagcgcgcttggcgggggaacgggacgccgcggggagcgcgggaggcgcgggcggcaccgacccggcgggggagccttcctgccgagccccgaccccacgcccaagtctcccgctgtccccggctgtcctcggcctgttgagcgcgtgggcggccccgccgctccccgacccccgacctcacgtcttttatctacttcggggctgcaaggaggtgggcagcgggcctctccccgccccccggtgtcgccggttcccgctggagccaggcgcgctctcgggctgccatctccccgccccgggaccgaaggacgccagcagagcggctgggcccagaggccgaggggtcagtgcccgagctggccggggaccagcccttccagcgccgctccgctccccacgcggagagtcaccgaaccgggcactcctcggggccaggaccgcggggcgcccgacggaagccctttctccccggggagagaacggccgcggcccgcagggaaggtccagccggagaccgggcgcgtcgggcggggcggggaggtgcagggcgcgggccttacccggcggggctgccgtcgttgcaggtcaccgaggtgttgagtaggaggtgcaggcgcaggtcctcgttgagctgctgcgcggagcaggggtacagggactgcgccaggctcttgacttgcgccatgaagctgtccatgttaccctccacggccgtgaagtccagcgggaagctctccacgggctgtccggccgccggcgccgcctcggtccgcgggggaggaggcggctgctgaccccggcgccgccaggtcttcctgccctcgctgcccccggcgcagtgcagcaggctcagcagcagcagcacgcgcacccctcggcccatggccgcgtccacctgcggggagcgggcggccttgaggcggcggcggcggcggcgggggatgccgggccgggggtgccgggccgggggtgtcgggggcactggccgctcctgctccctcgcccccgctcccgcccgccgggcctggcggagaaggcgcgcgcggctcggcgtcgaggcgctcggggccgggtgccgtcggcctccgcagctggggctccgcgcccggccgtccgagggcagcgcagggtctgggtgcgctggctgcggcccgc

SEQ ID NO: 706 - DNA, 39858 bp, Homo sapiens
cgctgcggccccgccccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggtgcggccgcccgcccggggcggacgggtaggcgggcggggggcgctgcgccgaggccccgcccattgcggtcggcgtcccggtgttcgggggcggggcctcggcggccaatgagcggcctcctgagcggcggccccgccccctgctcgccgtcacctgcgcttccgctggggtcccgggggtcccgggggtcccgagtgggggcggggcggtggcgagccttcccaggggtgaggtagaacggcgccgcgtgtcacccgcatcgagtactcggcgcccggccgagcccagctcgcgagggcgccgggaagagggaggagtggagccctagacccgcgttcccattccggggcgtcccccggagcgggagcccgggttgcgcggtggcagatgtcccggccgtggggcctggaagcgatttttgccgagtcactcactgcacttttacttgggcaccttgtgaccgcgaatcaattaaatgtaaaagtattggctgggcgcggtggctcacgcctgtaaatcccagcactgtgggatgccgaggcgggtggatcacgaggtcaagagatcaagaccatcctggctaaaacggtgaaaccccgtctgtactaaaaaaatacaaaaaaatttagccgggcgtggtggcgggcgcctgtagtcccagctactcgggaggctgaggcaggagaatggcgtgaacctgggaggcagagcttgcagtgagccgagatcgcgctactgcactccagcctgggagacagagcgagactccatatcaaaaaaaaaaaaaaaaagtatttattgagcctctgctgcgtgggggaccgtgaggatccgaaggtgcacacgactcggagtttgcgggagcagcccacggcgtggggtccccaggcctgggcaggtggagggcgcagccaggaggctgttggtgccaggcgtgcagagtgcggaagtggggcgctcccgcagaggctgcgcgggaccccttggtgcaaggccacggctttggctttttatggagaagaggggcggaggcggtgcaggcagtggcagcaggtgcacagaaccgtgccagagccagggggtagcttgtgctaggcaagtttaaggcaggttgcagaactacagggtttgaaggagagcccagggtgtgtgccaggaagatgcccgtgttgctgtactgcaggggaactctgagtggagctttcctacaaaactgaggggatggtgaagaagggagggagagtggacaggatttgcaggtgagagcctgcatttgttgcggggaccgtccatagtgtggtcttgtgcttggctttgcctgggcagagccacctggctcaccaggaagctgaatgcccttggctgacctggcccactgcgcccgccagccctgcacactcagcagttcaccatcctttcatctcacccccaggttctggaggacacgtgccggcggcaggacttcaacccctgtgaatatgatctgaagtgagtttgctccagctcagcagcagggtctgagtatatctgtgcccctgccccctgaacatactggctctcacttggaaaagcccccaggtggttttaaacagtcatatattccctcccaactctggagacccaaggccttggcagggccacactctctccaaatgccctaagggagaatccctcctgcctcttccagcttctcatggctccaagcgttctgtggcttgtggccgcattgctctctgcctccgatttcttgtggccttttcctgttttctctgtgtctcaggaagacccttgtcattggatttagggtccacttggataatctagaacgatttatcattacatcttcaaagaccaggatccctagtaagatgttcagaggtcctgggggtgaggacattgacccatcttttttgggggggccaccattcaaccccctgtaggttttattgcattgagttgcataagttcccagtggggctctgaggggaaagagctggccgtggagaaataggatgccttgaaaactgcaggtggatccctgcagtctcacagcccctggaattacacgtacgcttctgtgtggggatattgttcccaagagagggcttctgccagactctcaaggagtctgagacagcagaagggtcagagccctcatatggataggatgtgcgtgtctatcccacacgcgaagcttttcactttaaagtcctgttttctggtgttttttttgttttgttttgtttttgagacagggtttcactcttgtcgcccaggctggagtgcagtggcacggtcttggctcactgcaacctccacctcctaggttcaagtgattctcctgcctcagcctcccgagtagctgagattagaggtgctcaccaacacacccagctaatttttatatttttagtagagatggggtttcaccacattggccaggacggtctagaactcctgaccttgtgatccgcctgccttggcctcccaaagtactgggattacagagatgagtcaccatgcctgcccttgaagacctgtttttacagtactgttgtcctaacactgggggcagagggcaggagcttgccctcctggcattgcccaccctgccttacgaggctctcctgggaggagtttcttaggggtgatacctgccaagtcattccagtcttctaccttgtgtctggaccacgtgagaatcccaggacctgtgctctgaatgccaggtggtcttgggctttctgccccagaccttcacaccatccttctccagtctctcttgtcaactgaagaatgcggttcatatgtttggaaaggagggctttatttctcataaccggttgcagcttgcagggtggccattctaacaggctgggaagtgtagcctccagccagaagctggaaacagacacttcaagagagggaagaataagacagggatttacaccgaatggggtggctgatacagacgtacttaatacgctgtaggaggatcatgagtattcatgaaaggagaactgtgcacacagttgagcttcctgcctcttcacgggtcctatgtgcaaaaaatggcagtgccagcatgacctgagggtggaatttttggcctctgaagtcagaggtgaagcaggctgggtgaagtggctcatgcctgtaatcctagcactttgggtgcccgaggcggaggattgcctgagcccaggaattcgagatcagcctggggaacatagtgagaccctgtctctacaaaaaaagtaaataagtaaataaataaataaatggcaaatcagaggacatgaagactgtgccacgaaaaccctgactgtgccagaaccactccatggttggtggtttcttatcaggaaatacctgtgggttgttttgaagaaaccgcaagagagaagggcctggcgggaggttggctgatgtcagataccagcccaggggtctttggaaagggctgctttctgtttatcccttagggaagagagcctgcagatgtgtctgatctcccacccagccatggccaggaactcagctttcaaggtttctggggtcccctgggccaagaggaggctggttcagttggttggggggggcttagggtttcatttttatttcttttttattttattattttttgaggtggagtctcgctctgtcacacaggctgtagtacagtggcgctatctcggctcactgcaacctctgtctcccaggttcaagtgattcttctgcctcagcctcccgagtagctgggattacaggcgtgcgccatcatgcccagctaatttttgtatttttagtagggacggggtttcaccatgttggtcatgctggtcttcaagtcctgacctcaggtgatctgcccgccttggtcttccaaagtgttgggattacaggcatgagtcactgtgcctggccatttttctgaaacagagtcttgctctgtcacctaggctggagggcagtggcatgatctcagctcaccgcaacctctgcctcccgggttcaagcgattattgtgcctcagcgtcttgagtagctggaattacaggcacgtgccacgcctggctaatttttgtatttttagtagtgacggggtttcaccatgtggaccaggctggtctcaaactcctgacctcaagtgatccgcccgtcttggcctcccaaagtgctgggatgataggcgtgagccactgcacctggcctcatttttctttcttttttttgagacggagtctcgctctgtcgcccaggctggagtgcaatggcgcgatcttggcacactgcaacctccgcctcccgggttgaagcactcctcccacttcagcctcccgagtagctgggactacaggcctgtgccaccatgcctggctaatttttgtatttttagtagagacggagtttcaccacattggccagactgctctcaaactcctgacctcaagtgatctgcccgtctgggcctcccaaattgctgggattacaggcatgagccaccgcgcccagcgcattgttacttctcagtgttcacctgcccgtggtctgtgtggtggtgtctggtgggaaccagtgagtgcgattttgaggcaggtcctgcaataccatagccatgttttcaggtgcccttttcctctgctaatggtaccacttgcttacaaagtgcagccggtgcagaggaatgcagccccaggcgtgaacagtgccctccgctccaaggttcccagcctgcctgccctcgggatcccccgatctgctatcctgtcttgacgtagacatttcatgtggcaatttccagactcacttttctggccagtgttgatatagcaaagtttgttctctcttaattcttccagatgcccctgggctgtctgaactctcttcactagttgtctccgacagcagcttgcatttccaaagtgaggccaaccactttgagtatattcagatttttcttttcttttctttctttttctttcttgttttctctttctttctttctttcttcttctctttttctttttcttcctttctcttttcttttcttttctttcctttcctttccttttttctttcacagagttttgctcttgttgcccaggcaggagtgcagtggcatgatcttgcctcactgcagcctctgcctcccgggttcaagcgattctcctgcctcagcctcccgagtagctgggactacaggcctgagccaccatgcccagcttatttttttgtatttttagtagagatgggatatttttgtattttcagtagagacggggtttcaccatgttggtcaggcttgtctcaaactcctgaacctcaggtgatccgcctgcctcggcctccgaaagtgctgggattacaggcgtgagccactgcgcccgggcagtcaggttttctgtggtggctccagccgtgacggccggggtctgtgacactccagcttccgcgagtgcagcagtgttcacgccccagtcgttctctctgtgttttccgagcgtctgcactggggctgtcagcaccccagactctgaaggagcagccccctcggcgtgcaccgaggcccacatctccctttttcctgctcccttctgcttgcaggaggccccatatgatcggggacccgccttgtgcctctgcaggtcatgacgtcccgctgttggggagctgccacaggacgtggatggcggggcgtggatggcggggcgtggatggtgggacggggatggcggggcgtggatggcagggcgtgtcaggctctgcagggcagcaagtgtgctctggtctgtcttgcaggtttcagaggagcgtgctcgacctttctctccagtggagatttgccaacctgcccaacaatgccaagctggagatggtgcccgcttcccggagccgtgaggggcctgagaacatggtgggtcgtgctctgggggaggctgactgtgtggggcacaggatcgttcagctggccagggacgggggacgggacagtggggggtgctggggaaggagggacatgagtcttagcaccagttctgccttccctgggttgggcccaaacagcttcctgttttttgataactggcaactgaaaatgagcatctcatgtttttttttttttgagctggagtctcgctctgtcgcccaggctggagctcagtggcgcagtctcggctcacttcaagctccgcctcccgggttcacaccattctgcctcagcctcccgagtagctaggactacaggtgcccgccaccacacccggctaatttttgtattttagtagaggcagggtttcaccatgttggcctgctggtctggaactgctgacctcatgatctacccgcctcggcctcccaaagtcctcccaaaggattgcaggcgtgagcctctgcgccccgcccacgtcattcttcatgtggaagtttttctttctttctggggtcagttgtgccttccctggctcagggtgtcagcagcattcacccaccagcctgaccacctgctcatagaattgcccagaatgttagagccgaaagcgctgcatggatgccgcaagggcagcctgtaatcccagcactttaggaggccgaggcgggcagatcacctgaggtcaggagtttgggaccagccggccaacataatgaaaccccgtctctactaaaaatacaaaaattagccgtgggtggtggcggatgcctgtagtcccagctactcagcaggctgaggcaggagaatggcgtgaacccgggaggcggagcttgcagtgagccgagattgtgctgccactgcactccagcctgggcgacagagtgagactttgtctcaaaaaaaaaaaaaagagcagcaaacatttaccatctcatgtggcttctgagggtcaggaatctgggagcagcttagctcagtgtctgtcctgaggctgcagtcaggttcggtggagctgcaatcttttgaagcccccactgggacacgaggactgtctccaacacagttcactcctgtggcgcctgcatgtacccacacacacccacacacacccccacacacccacatacccgcacacccgtacacacccccacacacccctgcacacaccccacacacacctgcacacccccgcacacacaccccccacacacacccacacacacccctacagcaacgtgcacacacccccacacccgcacacacccgcacacaccccacacacctgcacacacccacacacctgcgtgcacacccccccacacacctgcacacaccgcccacaccaacatgcacacacctcccccccacacacacccacgcacacacctgtacacacacacctacacatctgcgcacatacccgcacacacctgcatgtaaacatgcacacacacgcacatctgcacgcacatgcgcacacctgcacacacccacacaccaacatgcacacatccacacacatacctgcacacaactgcacacccccgcacacacccacacacacatatgcacacacgcacgcacacctgcacatacctgcacactcacatgcacacacgcatgctggtgcagccctgccggggagcctccaaggccctcactccagagtgaataggagggtagccttctccgtgggggtcagcctctccctggaggccagggcggggcagtcaccctctctgtgtctggagaatcagtctgggatttagaaggaatagttgcttttcttcctaaggaagtttctcatgtcttataccctccaggttcgcatcgctttgcagctggacgatggctcgaggttgcaggactctttctgttcaggccagaccctctgggagcttctcagccattttccacagatcaggtgagcatcagtgggctgggggctcttccctaccctgtttgctggggaagctgctgtggttactgggtctggttcagagctggacacccaagctctgtgctggcctgtggtgcctcttggcactttgcagtcctttgtagaggaggggtgtgtgggctgccggttcatgagcagcagcctcggggatggctggtcacagctcatcgttctgagtttcctgggcccagcggcccagccttgcccacctagaagagcaggaatgtgcttctgtccttgtgggggcctggtgagcactaaggggagacgttcggtgctgggggcagggctccccatgcttgattcccctggatgggatcataaggtctcttttttttaagaggcagggtctcactatgttggtcacctaggctgctcttgaacccatgggctcaagaaattctcccatctcagcctcccaaagcgttgagattacaggtgtgagctcctgtgccccaccagaaaatcttcctaatagtaattggatggctgggcacagtggctgggcacagtggctgggcaaagtggcttgcactttggaaggccgaggctggcgaatcgcttgagctcatgagttcaagactagcctcggcaacatagtgaaaccccttctctacaaaaaatagaaatgttaggccaggcatagtgcatggtggtgcgtgcctgtggtcccagctatgccagaggctgaggtgggaggatcacttgagccgtggaggcagttgcagtgagccgagatcgcactgctgcactccagcctgggcaacagaacgagactctgtctcaaaaaaataaataaataaaaataagtaattgatgtgtatcagtttctgtcggttaatggtttaaacgttgttcctgaatgtgtaaaaattggtgctttgtcaatttgggtcttttcatcgttggctggaagtctctgtccacagtaaaaggctcagcagaatggaagggacttggggctggggtttgctgtgagccagggggttctcgccctccccgggcctcagtttcctcacctgtgccccggctggtgtgtggatggggtgagttcatgtcttgaggaccgagcatagggcctgtgggaaggtgaccgcgcgtcgggcgctgggaaggtgactgtgcgttgggcgcgcttggtggccccagggctgggcctgctcccgtctgacagtagtgccgcgctgcatggcacgggtgttgcgttcgtgggtgagagcgctgaggtctgcacgtcgggtctcagtggtcatggggatggaagccaccccagtggctgtcggggtgaatggaggcccctggagatggcagcgggttaagcacgagcacggaattctccctcccaaaacggaactcagacaacagtgacggagcctaagagcaaagccaaagccacgggcaggggtgagcgggacccgaggcaggagatgacggagcctaagagcaaagcgaagccacgggcaggggtgagcgggacccgaggcaggaggtgacagagcctaagagcaaagcgaagccacgggcaggggtgagcgggacccgaggcaggagatgacggagcctgagagcaaagcgaagccacgggcaggggtgagcgggacccgagccaggagtggcgccgggcagggaggcaggcagccccaggcgctgtgtgggcactgggtgagaagcagggatcccggcgccctggctctgtgctgcttcctgagacgagagtggcagagggcaagaagaaaaccaaacagcgcggggaacagaagtcaggaaagatgaacgtctggaaggaaatgcccctgggccgggcggtgcccccgggcgtgaacagaatccagtgctcccacaggcacaggtgcttggtgagggccgtcctccctggctgtgctgtcagtcctcagatggggatggaggtaaggaaatggcccagagtggcctggggctgccactggggaggggccgagggtgtctggagaggtggggccggcattgtggtagcataagcctcttcaacagactttgtaaacctcgtgtgaaacttagtttaagaaacaacaggcttggccaggcgtggtggttctggaagtggctttggagctggctttggtggtggctgtgggggtgggtttgggcgctttggaggaggttgcagtgagccgagatcgcaccattgcactctagcctgggtgacaagagcaaaactccatctcaaaaaaacaaaaaaacaaaagaaacaacaaggctgggcacggtggctcacacctgtaatcgcagcactttgggaggctgaggcgggtggatcacgaggtcaggagttcgagaccagcctggccaatatggtgaaactccatctctactaaaaatacaaaaattagccgggcgtggtggtgggttcctgtagtcccagctactcaggaggctgaggcagaagaattgcttgaacccaggaggtggaggttgcagtgagccaagattgcactcagcctgggcaacagagcgagactctgtctcaaaaaaaaaaaaaaaagaaacaacagaagtggctgggcgtgatggctcacgcctgtaattccaaccctttgggaggccgaggtgggtggatcacctgaggtcaggagttcgagaccagcctggccaacatggtgaaaacccatctctactaaaaatacaaaaattagctgggcgcaatggctcatgcttgtagtcccagctactcaggaggcaggagaatcacttgaacccgggaggcggaggttgtagtgagctgagattgcgccactgcactccagcctgggtgacaaagcaggactccgtctcaaaaaaaaaaaaaaaaacaagagcaagtggggcagctctttcgagacaccagggacagcaggaggtggtggggccgttggtggtaaagcccggagcccccagcctgcggccctggtctgtgtggcagtgtgggtctgtctgcgggtgtgtctgcacgtacacctcatttgatgaacactcacacctgtggtggagagtgatttgtggctgactgttgttgctggtgaatatgctgtggacatcttcctgaagggtcccgcacctgtcactcctcacagccatgctcttccgtcgtgtgggtgtcatgtgggtgttgcggggcatctggctgtgtctcagggcatcccgggcagggttgcagcagagtgtgcagctggaggcctttgcacctggtcacccaccccagcttctcctgtgggctaaattccagaggtggaatttaagatagggcttcttcacatttcatttccaggccgggcatggcggctctcacctgtaatcccagcactttgggaggctgaggcagatggatcacctgaggtcaggagtttgagaccagcctggccaacatggtgaaaccccgtctctactaaaaatacaaaaagcagctgggtgtggtggtgagggcctgtaatcccagctacttgggaggctgaggcaggagaatcacttgaactcaggaggtggaggttgcagtgagccgacatcacaccactgcattccagcctgggcgacagagcaagactctgtctcagaaataaatattaaataaatttctaaaagctcagacccaagctttgtcccagaagctggagtttgctaaccatggagcaggatatggacgaggtttcatagtgggtggcgttgccagccccacggtgagggtggagtgcctggtgggctctctgctgggagctggtccccagcaggtctgcatgagggagggaggctctcgtgcctagtgtccctgcactggcccaggaggcttggggaggccttgggaagtccaggtgtccgcagagtgggacgggcgggaagctgatgtttcttctttcatgtgtttcggaggaggtctgagtccagggacagtgtaggcgctgtgcttcgaaggggcgttctgaggctgggggctgcaggcctgtagcgtgcccaggagttgccctgggacagagcctgctttgtgtatttggggacccctgggtgatttccttggatggacactgccacgtgtttgaaacgttgcagctccactgcgagggtgtcactgtagcacgcagccctggcccgaccagcgtctcaagcagcaggggcctcagggataccagcgagccacacgtcggccatggaggtgactcacattttcttttctttcacccaggctggagtgcagtggtgcgatcttggctcactgcaacctccgcctcccgggttcaagcaattctcctgcctcagccacctgagtagctgggattactggcgcacgccatcacgcctggctaatttttgtattttttttagtagagacagggtttcaccatgttggccaggctggtcaggtgatcagcccgcctcggcctcccaaagtgctgagattacaggcgtgagccaccacacctggccaatcactcactttttcttgtaaccgcattaaagaagaaataaaaacaggtgtcattaattttagtaatacgtgtagttaactcagtatacccaaaatacgacttcctggacacgtagtcagtagaaaagtgagccgtctcatgctcttgttgtgcagagtccttgagacctgcatgtatggtgcacttggagcatctcggtctgggccgggtcctcgtggactgggcgctctccactctgcttctcaggctctgctgcagggagggcgtcaggagacagaggctgcacactgctggcttcgagctttcccattttccctatagtctgaaggttctgcccagcacagaggggtgtgaacagccacgccgagctctgggggacactgctctccgcctgcctggtgggcctgtgtctgagtttgggatcttccacgccgagctctgggggacactgctctctgcctgcctggtgggcctgtgtctgagtttgggatcttccacgccgagctctgggggacactgctctctgcctgcctggtgggcctgtgtctagtttgagatctttattacggggagtgtgccttccgtgataggagacgcatgagatggaaatgaggatttcatggcctacgggccctgggggtacacggccctcctggaggcacccggaggaggaaagggagtacctttctgaccagcatctttgctggggtacagattgttatgctaacgggtttcctatgaggagtttctctccatgggtttagagccagcaggcactagccccaggaggtcatactgtgactcgggggatactgtagcacgtctgggcagtccacgagggcaggcgggcgagtcccgtagtttgaatcccacgtcccgtaaggacctagttgccaagtggtgaaaggcaggggtgtggatggaccatgctgagctgctgggagcaggaagagaaccggggactgttgtgggtgaccgagacctgccgtggaacgatgccaagggtgagccgtgggaactcacacagcagctgagccgctttccatctgaagaccgtgagggagcagggtgggctttctgtaaatcagattcatgagctcagccatggaggggatttgtcctctctcagaggtgcccccgggctgtgctggcgtgggcaccccaggtgggagtggcccccagtgtgcccggcccctggctggatctcttcccaggcccccagccctctgctcccagccttgactcagtgcttgggggctggctgagtgcatctcagcctgttcctccttctgtaggtaaagccgtggctccgggaaagctgggtgatttctgcagccctctgggtgtgctggggtgtagggatgggctgctggtgaggacagggctctgccaggtggagcactggcctgtggccacactcagggtgggtctgtgcatgctgctgggccagctcagagctctgcggcccgtccctgtccatccctgcccgtccctgttcatccctgtccgtccttgtccattcctgtccatccctgtccatccttgtccatccctgtctggacctggctgggttgagaaggccggagcctgccccaggctctcccaggctctgtctagccgcttggcggctgggctgtcatgtggtgggtgatgccctctgcgggcctccctgagcccagtggctcctggcctgcagccacagcttctgttcccggcagggcgcatgctgctgcctgggctctcgtcagcacctgtgtttgcgcccggctttgtcatacccagacaggacatgaacacagagagctctagactcactgccttgtccccagcacacagccgcgccttgccggagcggggccccagcggggcggggtttgtggtgcataaagaatatgccctcgaagccagcagcagaggcgtgtctgccctcctggccgtcccgctggcttctggccctggccgggtggggagctctgctggctggagagtgtgtgagagtgtgccagtaccctgctgcgagcaggcacccgcggaagcgccccaaagcacttcttgcatttctggcttcggagcatggtgtctggtggcttggcctggcctggggtccccgggaggccctgggtcttgcccctgcggacattgggacttgcagaggtctgcgtgggggagggggagtaggggctgtgtctcctcgggcgctggaatttcccccgggccctggcgtcctgcacactgggccggcgtagaaggtctggaaccgattgcccaccacccctccctgagatcccgcatgagggagggaatctgatccctctggaggagccgcacatcaaagccgggctggcgtttgatgtcacgctgctgtgctctgtccctgtttgtgatttgaggtccccaagctggcggtcagtgccggggaaggactgtgagttgggactctggccacccctcagcccaggcctccccagccgtagagaagtggcctcatgaccatctccggacccctggccatctgtgtcatgctggggagcggggaccctgggccctccctgtcccccttcctggccctgggggctgtgcttccttgaggcctctctctgcctctgtccgggttctgctccggcgcattttgaggccttgtgttttcctgagccctgcgtctcggggcctctgggccgagtctccagccatttggagggaaggcaaatccaaggccctttgttggctgctctgtgggacgggagcttagggagtgtgtcccagcctgtgcgcagaggacacccgccgtgtgtgtggtgcgcacgtgctccacaggctagaggcccttggggaaggggctcccctgtaggcagtggacccagggagaccatggggctaagtccacgaccctgtggggcctctgcagccagaccaggctgtcagagtcggggcctgggtgggaaagggatgcccctcccccaggattgaggacgtgaaaaataaaggccacgaaacaaaagaaaacacgtcaaacccacacacgtggccgagtccccaggtgtcggggctgggcctgtcctgggtgtggcaccttgggcttttctgcttggtctgttctcatttcagggaggcaagtcctgcccttttttttgttttgttttgttttgtttgtgtttgagacggagtctcgctctgtcgcccaggctggagtgcagtggcgcgatctcggctcactgcaagctccacctcctgggttcacgccattctcctgcctcagcctcccgagtagctgggaccacaggcgcccgccaccacgcctggctaattttttgtatttttagtagagacggggtttcattgtgttagccaggatggtctcgatctcctgacctcgtgatccgcccatctcggcctcccaaagtgctgggattacaggcgtgagccaccgcgcccggctgagtcctgctctttcaagtaggtcagcagatcccagggtcggggcacggtgagtgcacagtggacccctgcggccctgtaagcacacaggtgggttcaggcggaggccgagagttcctgtcccagcatcccgctctgtgcatggatgtgcacgtatgtctcgacctggacactgcagcaccctgccctctgaccctcccagtaccccccatcccggagggttgctgcaagcagtttccagcccagctgttacctaatctttatcccctgtgttctggtcaccagctcagcctgtgtcttcctgtcccacctgagcccttgcaaggcacactggccatagggcctggcagggcacctgcatgacctgaggccggccctggcctcccctttgcctaggctctggccatctgccccctcctctcggattcccctccctggagagggactgatgaggggcatctgcaaggaaggcctgagaagggcttttgtttttctcagtggggaggatttcacggtggggagttggaaacgcagaggcaagcccgcctcatgcagcaggtgccaccagcagttcacatgctctggggctggatgtgacggcatgtgcccgtctcccgggctgccatgcacatcaggcatgtgtgggaggcgtgctgcatatacctgcccacccatgcacgggtccagctgtgcctcctgcggggcgaggctcagaaagacactggtggcagagtccgacatggacttataagcacggcctccccggccacaggcaagcgggcgtgagcggagtgcagcgcccctccctccatgcttcggtgacatcaggcgtcggctttgaaggaggacatcaggcggtggagacaggggcacctcctcttagtgggcggcttaagatgaaagcccagacgtcggtaccctgactctcaggctcctgagtacaggtgtccgtgagccgcattccggagccagtgctgctcgcccctcctgtgcggtccctgggccctgccggcagctccacgtcctgccagcggccccgagactggaggtctcggggggagcccccaggccacgcaccacaggccagggtccttgggagcgcccccggctgtcaggtgcctccttttggtggttgtggggcgcagtggggctgaggtctgtggcctgggcctgggcctgggacgctgtcctgggtgggtgctgggtgagggccccacacctttgctttccgagtctcctgccccagggcctccgtggcactggttgagctgccctggggtacctgatggtttctttcctctcctcccagggagtgcctgcagcaccccggcggggccaccccagtctgcgtgtacacgagggatgaggtaggcggcctgctcttgctcacccagtccccgctcactttcagcccactttccaactggaaaatctgctgtcccgcagccgtctccagggcagtggcgggagactcgggctcttgaaagcacgacgtgtttcatggaaaaagagggagtggccggccctcggagcccgggctgccccgaaacctccctcggcgccctgtttgttttttcagcttctctcaaagcccaagagtcacaaaagtggtttcatttaataaatatttgctttgctcggtgttttgatcattttcaaaaccgagtgtggcgtggcgcaagcaaagcccgccgtggcgggaccctcctagcgctcgtccctggcctcacaggggccttttgtttccacgctggctgagtgccctttgctggggtgggggggcactggcccggaggggccctggggggccaggacattccccgcatttatccccatttggaagctccctggctggggctgtgacggggaggttcaggtctacgtcctcccttgaggggatgagccacggggctcaggacccaggcccagcactgtcctgaggctgtggccctcagggacccttacaccctttggcttttgtgctgggccattgactgtgccctcgctagaggcagcttctccaccccttcctcacaggtcagagttagcgtatgggacgtggccagccaggcccgatccctgcccaccccgagctgagcaccaggaatggccacccccgtgggtgacagcacgttcctgcctctctcgctccgggcagtgggtcctggcaccagggcttcctccttgcagcccagctctgccagcccaggcctcagtgagcttgggtcccagctgcggagaccaggctgggggagacacggtcaggcatgggcagcaggtcctgccccggctgcagaccagactcaagctgggccttgtggagggtgtggaccggcaggggccagatgtggggggtgggtaggatggaggccagagagggcacgtggcctgtggtcctggtggtgccggtgcccggagggcttccctgggctctggggtcccggtgcaaggcgcacctgtcctggctgctcctcctgcaggtgacgggtgaagctgccctgcggggcacgacgctgcagtcgctgggcctgaccgggggcagcgccaccatcaggtaagggcagtgctgctggggccgaggagtctatttagctaaaaaaaaaagtggtctcaaaggaaaggagaaaggacacgtggcaagtggggagtaggtgtacccaggccctcatcatggagagcgcctggtggcctctgcctgcctgtgggcgtgggggctgggctgccccgacctcatctctgtgtcccccagaggggcggtggatcttgggagggcgcatggggcaggagagggtgaaccgggggcgggagagggtgagccgggggcgggagagggtgagcctgggccgggagagggtgagccgggggtaggcaccacaaggtgcttcccttgtcctctggccccactcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcgggtaaaaggggctctaggccttgggacttgggggtgtcctttctcctgatgtgtagccctgcgtggctttagctggtcagcctggtggcgtggccgtgatgcgggcagaggaacccaaacgcgcagaggaacccaaacgcggggctctggacaggagccttctgacttcgcccaggaaggaatttaggggtaagcaggtggtagagaaagtagctttactgagacggtggctgtgtctgctccgggatgaggccgtgtccgctccgggatgaggccgtgtgggctccgggatgaggccgtgttggctccatgacaaggcggcaactgtgtcagctccgtgttggctccgtgatgtgtggcacagagcagggccgccctggggtggtgcatggagggcagcagctcagggcatggccgtggtcacatttacatccactcaactacatgcacgttaaggggtggggcattcagaaatctctagaaaaggggtggtaacttccgggttatggccagggaagggggagctggtgaacgcatcagccagtcttcaatctggtctggaatcaagccccacctcctacctgagcagggtcactgggcttgttcttagcttctcaggcaaatgatttttttttttctgggtttttttttttttttttttgagacagagtctcactgtgtccctaggtgggcgtacagtggcgcgatctcggctcactgcagcctctgccacccaagttcaagtgattactcctgcctcagcctcccgagtagctgggactacaagcgcgcaccaccaagcccagctaatttttttgtatttttagtagagacagggttttaccatgttgtccaggatggtctcaatctcttgaccttgtgatccacccacctcggcctcccaaagtgctgggattacaggcgtgagccaccgcgcccagctcttttttctggttttaaaccacctttactgaggcacccactttttttttttttttgagatggagttttgcttctgtcgcccaggctggagtgtggtggcgcactttcggctcactgtaacctccacctcccgggttcaagcgattctcctgcctcagcctcccaagtagctgggactacaggcgtgtgccaccacgcccagctaatttttgtatttttagtagagacggggtttcaccatgttggccaggctggtctcgaactcctgacctcaggtgatccgcccgcctcagcctcccaaagtgctgggattacaggcttgagccaccgcgcccagcctaatttatttttatttttatttttcataaagacgaggtctctctctgttgcccaggctggtctcgaattcctgggctcaagcgatcttcttatctcagccacccaaaatgctgggattacaattgtgagccacctcaccaggcctgaaagttactttttataatattgtggatagtatcatgcttcctgttacatctttgactggctgactccttgctagttctagtggcgtcttggtttctgtcggggcctctgcagacctttccctttgtcctctcatcgtttttcttcctgtgttgcagcgaatgggcctctggtgcttttggatcgtggcgatcttagtagacatccttccttgtcttgatcgtaacaggaattactagtcatttctctgccaaggatgatgtgtgctataaaaagcctttatcaagcagagaaagttactattcctaactttctgacatttaaaaaaatcttaagtgggtgttgaaccgtttcagtgttttcagcatcaatggagatgaccgtatgctttattttattggcttgtgcatgtgtgttcataagtgagacagactttttttccttgctctgtcttcatccagtttgggaatcgaatttcacctggctcacaagggagctgggcagtggcccctcttttctgggttctggaagttctccgaaggttatggccactgctcactgcagactacacccaccactggggcactgggcccttggcggggagtgcatgcaggcaggcggccaggtgctgacctccgagcatgcctgtgtgtggctgtggcctgaccctctccctcacgcctccccccaaccgtggggacctcgtgtctgtggggtccctggccctgtggctgacttttcctttgtccctgtcctgaccccgcatcagagccctgcacctgggctgctgaaacctgacttcctcagcttcctcacctgcagaactaaggtgttcgtggcatttatgggttttgtgccaaaagaggcagactgggggactgtcatgcggctttcggtgacagggatgggaggaggctgtttcccagcccctgtgtcccctgagggccaggctgccagctgccagccacagcccaggggccaggtcagagcttcttgagctcctgctgacgtagtgggcctggaaggcccccatgcctccatctcctgtggacatttaaaatatttgtgtctgggcctgtggcatggtggctcacacctgtaatcccagcagtttgggagaccgaggtgggcagatcacctgaggtcaggagtttgagaccagcctggacaacatggcaaaaccctgtctctaccaaaaatacaaaaattagctgggtgtggtggcaggtgcctgtaatcccagctactcgggagactgaggcaggagaatctcttgaacccgggaggcggaggttgcagtgagccgagatcgtgccactgcactccagcccgggtgacagagtgaaactccatctcaaaaaaaaaaaaaaaaaagaaaacaagaagtggccaggagggctctgtgcacatggccccggcctcggctgtcccctgggcactcgtgctacgtgtcccggaactcaggtgaggtcaggagtttgcttcctcctcctctggccacttctgagtgaagcaacctcatgcctccctcttgcctcccggccacacacctgggagggcagaggccgggcgtctgcaccgtgttggatgtgggggctcccatctagcccggcgtcagggtccagcccctctgttttctgtccccctggctgtcctgggactgttcctgttgagtggacaagggagtggggagtgagggtgttgggtccattctaggactatgatggtgttggcaccccatcctccctctgggaactctgccaaactctgcactgtgacacctgagtccccatgaagcgctcgtgcccctcgacccgtgtgctccgggtgagcaggggctgaccccctctaggcctgctcttgtggggacccctcagtgtgagagacacagtggctgtcatgttcccccattctagaggcgtgggcctcagccccttccctccgtgaccagggcgggtcttgtctgcagagcgtggggcgtggagcatggggctcgcagcccagagtagtgcccgcccgtgctcgcccgtcgggaggcgctgttggggtggggtcttggctggcaggaggggtccaggggagggagcgtgtgcctggcctgcatggcgtgctgagggcctttgatctgggacttgggcagctgattgatggagggcgtcctgcctgccccgcgcctcccatcgccgccagccgcacacgcagagggcccggggccacatgccgctgctgggtccctttcagtgatggggggaggggagaagggaacaaaacagaacttttttggggaacttcaaaggtacactttagtaagcaaaaagagtttccaagtttcccattaatgttttgcctgtgtgtggtttttggacttaaataaagagtcagaaggaagagacaggataaaatacaggcaggtcctcggccgagacccggggtggttcacagacccgggcggttcctgcctttgatgtcaggcattaattattagaaggtagttttactggcgatcagaaccgggcgctgggagaggctggggctgcccggcgccccctggccctgtctttgaagtgcctccactggctgggaggctgccctgcagccctgtgctgggctgggacgccagtcccagcagacgccccccacaactcggcctcccggcagctggcacgagggccgctcctgatcaaaggctgggtctgcccgcacgggctggcggctgctgccctgcctgcccctcccgcctcgggggtgaaccttgctcctggagccggggcctggggtttcctcagcacccctgctcacacccggccctctgtggctgacagccggtgtgggactcgtggggcggggaggagcctgtcccagggttttgggggtaaaccagcggggaggaggctgggcctggagcgggtcatgcactgggcgtggtgaatacaccctgcctgggacccccgtgtgcctggcagggcaggtgctgttgaccctgggcagtaggtattgggccaggggctcctgcccctggaccctgacgccgggctagacaggagcccccacatccgacgcggtgcagactcccatccctgcggccagcacagtcagtggccagggtggcccaggtccctgctatgcctcatgggtgtctgaggacaaccctgggctctgaggctgtccctaggggcacagcctgtggccttgattggaatggccaccaagcgtggctggcagatggctcagcgactttgcaggtggctggctgagtcccggctgtttagaagcctggtgactgacaggcgcttgtgttttggtgaggaaccccggggggtagggggtggatgctcgccactggggctgtggggagaactgggagtgtggggctccgtactgggcgagtcggctgctgcagggcgcagaccccactggccccttctggcctggactctcctccccgttgggcccaagatcccctggttgggattgttccaggaactcaggtcaggggccccgtcagcccttcccgggctcccccaggagcagcctccagactctgccctgcggatgacccccctcaccaaactgcttttcctgcctgtccgggggtgttggtgcgctttatccacagtgacacacgcctgccacaccgtaacgtgcccagctccagacgggctcatggtcagcccaggctgcagcagtcctgaatcctgttcttatttttcttttcttttttttttctttttccttttttttttttttttttttttgagacacagtctcgctctcttgcccaggcaggagtgcaggggcacaattacggctcacagcagtcatgaccttccatctcagcctcccgagtagctgggactgcaggtgtgagccactgcacctggcctcttttcatcttctaaagtatttttctttttaaaattaaaaagtgatttttttttcttatgagtacctcatgctttatattttcatcttttcattttcattttattttattttatttatttttttgagacagtctcgcgctgtcacccaggctggagtacaatggcacgatctcggctcactgcaaccttcccctcccagttcaagtaatttttctgcctcagcctcccgagtagctgggattgattacaggtgtctgccacctgtaatttctgtgttctttgtagagaaggggttttgccatgttggtcaggctggtctcgcactcctgacctcaggtgatccacttgcatcggcctcccaaagtgctgggattacaggtgtgagcctctgtgcccagcctatttttatttttatttttattttttgagacagagtctcactctgttgcccaggctggagtgcggtggcatgatctcagctcactgcaacctccacctcccgggttcaagtgattctgctgcctcagcctcctgagtagctaagaggcgcctgccaccatgcccggctaatttttgtatttttagtagagatggggttttaccatgtttgtcaggctgatctcaaattcctgacctcaggtgatctgcctgctttggcctcccaaattgttaggattacaggcgtgagccaccgcgcccggcctgttttcatctttttaaaataactttttttttttcgagacagggtctgtctatgttgcctagcctggagtgtggtggtgcgatctctgctcactgcaacctccacctcctgggttcaagcgattttcgtgtctcagcctcctgaatagctgggattacaggtgcccgtttagtagagatggagttttcatcatgttgacaggctgctcttgaactcctgaccttaggtggtctgccggccttggcctccgaaagagctggcattacaggcgtgagccaccgtgcccagcctaaaataacttttcttggctgggtacagtggctcgcacctataatcacagcacttcgggagaccgagctgggaggatctcttgagcctaggggttttagaccagcctgggcaacataacgagaccccatctctacaaaggaaatttaaaaattagtagggcgtgatggtgtgtgcctgtagccccagctacttgggaggctgagacgggaggattgcctgagcctgagagatcaagactgcagtgagctgagattgcactgctgcactccagcctgggcaacagagcgagacgctgtctcaaaacagaaacatctctgctttgggccttccttgttggcctctccccagccatgtggccactcgctggcaggcccgggccatgagcatcggtgcggatgctgtgctcagcctgggggcggcgccgtctcctctgggtgggattcgaggcctgatgcctctgcctggtgcaggagggatgttgtgctgagggtgttccccgtgctttggatgtaaaatttgggcatggagtttgtggtgtcttcagaggcagtcccgcctgcgtcctttgtgcatgcctgtccacgccggtcgcagcggtctccccacagagcccgcgcccacgccctggcacagcctctcctgctgtgcacgtcccaggcctttgatggcgtccacgtgctccgccgcctgcctccgagggtggccggggcgctgagtaactcgggaggtttggcccgtgtctggcgtagtgattcattgaagctcagagcctccaggggaaactccacactccctctcaccggagccctggcggggcaggccgggccgagacggtgggagggagggaggccgggagggaaaaacacaaaccctcagagacgctggaaactctgaggttggggccacctccgaatgggttcacatttttcctctgtgtgtcatcacatcctggaaaattactgtcaagaaaaggagacctctgggcagtgtcccggcctgtgtgcatgcccctggcgccctcaccctgcagcccccagcctccctcccctcggtttcccagctcagcggcccagggatgccccagcactgtctgctgtgaggccgcgcgcccgcagggctgcccccggcatcccggacagcgtccctgtccttagtcctgcccgtcctttctggcctttctccggcccccttccagtttcggggcatctggataaatggttagcatcattgtggtccggtccttggcggccctcctggaggccgggacctgggggtccaccgggggcctgggtttgcaggagacaggaaggggctaaaggggcagaagcatgcaggggcttcacctgcaggaggagtcgggtctttcacagctgcccggccaccctcggagcctgagaggccatcacacctttccctcatggtgccagctggaccctccacgctccttgcctccttgtgtgtcatgtggcagccacaggcacccccaccctgtggcgcattttgagcttctggggagctcagcacacacagcccctgtgaaagtgcagtgccggctgctggaccctgctgtgcccccggcatcacccctgtcctctgagacctctgactctgcccagcaagaggggcagggtcgggaagaagggagtgtggggcctttggaagccgggcccaggcagtgaggcggaaaccaggctgggctcagcatggcgagctcctcctggtgaaggcactggtgtccgggggcatcagcggcacagagaaggttctgggctccatctcctgaacctgtctggaagagcccagctgctcccatggacctgcgacctgctgcccggggccgggggtctgggcctctttgcatcggctcaggggaggccatccgtggctgggcgagggtcagctgccatttggatgccccggcagccgtggggctctcgcctctgccagagcaggcagcttccgaggtggcaagggctttggggagcagcgggaggcctgggggtgccgagtgttccggaaatattgctggttcttctggggcagtcctggcccgctgggcagagcagaacacggcctctgctcagtggcagggtggggcgccggggtggcggaaacatgaggccgcgtgaagtgggcatcagttgggccctggggtttggtctcggaggcctgcggggcagtggtcccccggctcttgctgccctgcggttcagttcctcctgctgcagcgcctgtgtgccccgtgggtcggcaggtctcgtgagaggcctcatctgagacaggaagccccacgcaggcttctggaaggctcctcctggctctcagccaccccgttggctgagtgagactgaccccagcagcttcctgaggcgtggcaaggcccccagggacacctggcggccacacacctgggggaccccaccaaggctgagacccaggttggggccccctgcactgctgaggtttgggcctcattccccgctggccctccgtctgcttgggagctttccaggtggggatgtttgtagggacagtggtatggcatccagttgcctcctccctgaaaccttcaacccgaacctcactcagcacagagaattgggggccagaccacggcggacggaggcgtcctgctgacacagcccctgtcgggatgtgggaaggggcggaggcacagctccagccccagcgtgaccgtgtgtgtgggaaaaccgtccgggtacttggggacagcagggacatttccagtgtgggtgtgtgagagccacctcccccatgcggtgggccctggtgtgatgctggcagctgggacaagagtccttctctcagcagatgctgctgtgctcctggggcacagtctgtggttttcttttgtgtgcatgtccatgcttgggtgttgtgtgcatgtccttgcgtgtgcgtgtccttgcgtgtgcacgtgtgtgcttgggggcgtgtgtgtgtccttgcgggtacacatgcgtgcttggggtgtgtgtgcatgtccttgtgggtgcacgtgtgtgcacgggtgtgtgtgtgtgcgtccttgcatgtgcacaggtgtgtgtgtgtgtgtgtgtccttgcgggtgcatgtgcatgcttggggggcgtgtgcgtgtccttgcgggtgcacgtgcgtgtttgggggtgtgtgtgtgtccttgcgggtgcacgtgtgcttgggtgcatgcaggtgtgtgtgtatatgcatgtctgtgtgtgcacatatgtgcatgcatgtttgccccagagcggaaggaaagtgaatgcagccgaatgatcacatctgcatgaggggtgttcactgttgtgtctgcccatctttctgtgggctgaaatatttcaaaataagaaattgaggggaaagagaaaggagggtgcttgtctctctccttgcctcctgctcctcctccctgtgttggaggctccaggacgcctcacccccggttgacgtcatttttggcctgcacaggcagcccgtttcttttctcctggcaccggcgaggaggctggggaggggggacgggaattcccccaggggccaggccttgactgccctgcagggccctcgctgtcgcttttttccctcacagtgtctcatccctcaacctctgttttccatccaaaggcatctctgtgaatccacctggcgcgggagcggcgctgatgccacaaatgcgggccagactgctgggcagagctcaccagtcaacagggctgggtgtggctggggcagccctgagaccccaggccctgccgctgtggctcccccttcctggcccctcttctctgtgggacagaaagtctctcctggggaaggctcggagctgagctgatgggtgtttgaagtttctccacacacagggtcccctggcatctccctctgtcatttggtggccaagtgacatttcccagcagccctactgcagacgccatatgttctcggggtgactcaggtggcctgggcccttctggtagccgcttatccagcctgaccccaggctccagcgaggctgctccggatcggggctgctctgcccaggtgaagggcgggtgtgggaggtttccgtagaggccgctctcccctgctaccacggccccgtgtgggaccctgggtctgtctgacagacagaggcttcctgagccaggcccttgggatgacgggtaggaatctagggtggatccacaggaattagagattttttcagttttgttttccaaatgaagtcaacagccccctagcagcgtgatgctgatggtcctgtcccctatggcccccatcctggaggcaccctggtgtgggctgtgggcctgggggtccttggcactgtccagtatgcggacgtggcagcagcccacatttcccccagtgaccaccaggctgtgccctggacgtggccgcctgagcacggcatgtcctggggccccgtctggtggtcaggctcagtacgagcccatcaggggtactctgcccgcctgggaagacagtgtggcttctgggggctcctccagggaggctctggaccaggctgcagaggatgccaacctgccacaggctggcctggccgctcatggacatggcggctcctggcccagggtctctcccccgggaacccaggcgtgctcgcggccctctggaatgcaggcgctggggctgtggggggccgcctggcgcctggcatcttgttataaaaagctctggcgcaggctgctctcagtggctgcaggatggttgtggctttggaagggcagcccccaggggccttggtcagccacctgtgggccccactgccgagccgtggtcagccctcactggctgccctgccatgacgctgctgaggtcagtgcagctcccgccagactcccgtgacaagtcataacagagccacatgctgggtggctgcagggccctgtcgcccacagcagtcgaggtctcaggtgtgtccggagggcagccctggagacacctgggacaggcgtacctctggcaggcgcaccctggctgtcacccagtgtgggcatggtgggggtgctggaatgctgtgtagggcaggaggcagcagcccgtggctgggtgggagactgcagggtagacgggacgggaccaggagggttgttcgcagggactgccaagccatccccaggtgtcgagagtgtgaggtaggagtgggagcccagagccggctccaggccaccccaactcccgacagctctcggctgttctgtgtgaggggggacggggccgagtgtgggtcggcgcagtgctgaggtgtcccacgtaccccagcactgtgctgaatgcattgaaatcactgcccagggctccgcgagctgcacggcccggctttgtcaatttcattgctgttgatgccaattaggggtgacgctgtccctcccgcatcccagggtgggcagagggaggggccggcttgttccctgggggcaggcgtgcatggattcagcctggccatggagctgtggccaagagggcagcgggggcagctggactggggtttttgccgacgctctaatttggcggctgtcgccacccctcccccccatggagaccctgacgtggcctgagccagactccaggggccatgtgccctgctggggagcaggggctcagcatcaggtctggtgcactgactgggagaggggggtctccagccctggacaggctctgagtggggtggggtcccccagctgctgtgcccagccctgcccccaggacctggccttggccctgcgctggccggggccagggagggagtgggcccagctcccaagtctgtgtgaccacctcggctggggcactgacagcccggggtgcggagggcccagcccgtgacacccgccgtcagccgcgccctctgcctccagcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggtgggtgccccctcagtgcctcccggcatcttcgcgccagggtttgccccatcgggtgcttgtgctgcccgctgtccccagtgccagcactggctcccggcccaggtccctgacaggctgcccttaacaggacctcagagggttggggcccagggaggggcgtccagaccttcctgccttgtgtggggagagcagcccactcccaccctggagggtgcaggtgaggagcccggggcctgttgccagggcccccattctgaccagaagccctgttccttcccctcctcaccacaggaagcgcctggaagaagcccccttggtgaccaaggccttcagggaggcgcagataaaggagaagctggagcgctacccaaaggtctgcagacaggatgtgggggcgactgaggcacagctctgagggggccccccgtgaggtctgtggacgggatggggcgactgaggcacagctctgagcgggccccctgtgaggtctgtggacaggacgtggtggcgactgaggcacagctctgagcgggccccctgtgaggtctgtggatgggacgtgggggcgactgaggtacagctctgagggggccccctgtgaggtctgtggatgggacgtgggggcgactgaggcacagctctgagcagggcccccccgtggtggcgcgcatgcccttagtggccagttgatcctcccctgctcatgatttagaatgaaacctttttttttttttgagacggagtctctctctgtcgcccaggctggagtcagtggtgccatctcagctcactgcaagctccgcctcccgggttcaagtggttctcctgcctcagcctcccaagtagctgggatttcaggtacccgctaccactagctcggctaatttttgttgttttttttttttttactagagatggagttttaccatgttggcccggctggtctcgaactcctgacctcaggtgatctgcccgcctcggcctcccaaagttctgggattacaggcttgagccaccacacctggctgaatgaaactttaaacagcacatttgagccgggcgtggtggctcacgcctgtaatcccagcactttgggaggccaaggtgggcggatcatgaggtcaggagatcgagaccatcctggctgacacggtgaaaccccatctctactaaaaatacaaaaaattagtcaggagaggtggcgcacgcctgtagtcccagctgctcgggaggctgaggcaggagaaaggcgtgaacccgggaggtggagcttacagtgagccgagatcatgccactgcactccagcctgggcgacagagtgagactccatctcaaaaaaaaaaaaaaaaaaaaaaaaccagcacatttgaacccaggtcagtgtggttttagaacgcaggccgctgtgcacacacacggcacttggctgtctccatgcccagcctgccacgggggagtcaaagcccaggccctgattgggggtggctgcttctgcctgcctcagccctggtgtccatggcccagcatgggccgagtggggaggccacgccctggtccctggtgcagctccggccgtccctccaacccttccacttgtctggcctaggtggctctgagggtcctgttccccgaccgctacgtcctacagggcttcttccgccccagcgagacaggtgggcagcgctgtggggtgtccggggatggggggcaggggcccatggggcctctcccggctccttccttccaggccacaggactgcagccacctggcctgcgggctccagggcactgggtgggtgcgggtgctgatgtccccttgggggtgcagaggcatcccagttcgcagagtgtcaggcaggctgggcgcttgctccaggtgcccggccccagctcagggagcccgtggtcctgagtgctcacgtcgcccacctactgggcatgggtggggcagaggggcacccagaggaaggcaccctaccccgggaggagggcagtggtgctgtgacattcaggggcttgtgacctgtacccagacggccgggcggcagcagcccaaggtcacaggggcctcccccagggaaagggaagcgcttaggctggggcgggggtggggctggggggcagcgggtggcagtgggagtgctctccagcagggcgggggtcccaagtgtggcccgcacggtggcccagccacgccgagcacctggagtgctgtgggaggaacagggctgaattcccacccctcggggaaaggcccaggagggtgggagcagtggcccaggtgctggggcagcccggggctggcgtggtggaagagctgtctgtatgttctttttctcctctgcagtgggggacttgcgagacttcgtgaggagccacctggggaaccccgagctgtcattttacctgtgtacgttttttctcctgagcccactcctgcctccagtgctcggggccttggtgctgtgggcacaccgcccgtcccagctggggctcgtggcagcttctccacaggagcagcatctgtggcctcccgcccaggtgcctcctgcagcccatggtgtctgtgtggagacctaggagggcccttctccccgagccaggcggtgggagccaggcttcctgccttctctctcagcgccctgctcccctctggagccctgctgcaccccagcctggtccccacccctggggctcaggccactcctgcccgagggctgtgggaagggtgggtggacagggagtggctggcctcccttggagggtgtctaggtggcaaagggttaggctgcccactgcaaggggagccgggctgcacgggtggtgtcccctgcaggtgggcctgccccccaccggcccttccgagccctcagctggagtttctgcagcaggagtgtgggcacagggcgtgctcgtgaggggctcttctgccccacttgaggcgtcacccccatctgcaggcctgtcttccttcgggcgcatggatgggcgaggtccacggtgcttcctaacacgtaggtgccttctctcctcagtcatcacccctccaaaaacagtcctggacgaccacacgcagaccctctttcaggtacctgagggcctccctggggtgctgcggggcggggccctccagggagggcaggacgagagcgtgaggcctcgggcaggaaggaggggcctggcaggcgctggggcaggataataaagcctttgagagccggtgggttccgagggggccgtgcgcctctgaagttgcttctgacacggctttccggcctcctctgcttcctgcctggccccgggtgggaaaggacctgctaggcggcctgcctgaactgaggccgcttggaggtctcggcccccctgggctgctgtgctggggccaaggcggcagcagtccctgcccaggggtctgggtgaggaagggcccggcaggcctcggagcagggctcagggagccccagagggaccaggccctcagctggaggcggccgccttgggcttcagctgccccttccccctgcccggcctctcccgctggccccccggtccctgctaggaacgccctggtgcccatagctgtccgctgcttctgtgggtccctgccacctccctgagggctcctgagggtggggccagggtgagggtgccgggttcccagccctgctgggccgccctccagagccagaagcaatgaatgtcctgtccttggcctgtgggagagctgcctggggccttccgaagccctctggcctaatggtttcctcttcaaagcctcttcagatattttaattagccacagaggcgggtttttttttaagtggccacaggcctctacagaggcctgggttggaggtgagaagcttgctcactgcctggggctgcagccgcttactgagctggggcaagaaggctggcagctgccaggggtgatcaggagcaggactgagcgggattccctgcagcggaggcaggggaggggtgagacagtcccctctcagcccccgagctgccgggcggactccgggcctccttcctccgtctccatcccctcccttgctggccagccagttgataaacattgaatttggaagatgccttgggatggaggaggaccagtgcccaggcctgcagcccaccctcccgctgggaggcccctgagagcactggggtgctgctgccctgtttctggggacgcttggcttccctaccagccaccgtctcctgccctccatcagctcggctctagcctcggggcctctcggggtggtgtccccggtgacgtgcctgcctgcctgcctgccgtcagagagctggcggggctgagggaaggaagcctgcctccctggcaggcaagcaggcggcgggcgcggaagcaccagctttcacgtctctggcagagccccactccggctgcctgctgcctgggggatgtccaggggccggcccccggcttccgagagggacagcgtgcgtgggtgtgggggctccggtagcccggcagccctctgtggccctggcccaggagagtgcaggttttctgggagggctgggaggaggcggccaggagtgaggacagggaattgtgagcagtgtgggggcaccactgtggggaacaaagccccccgcccctgcctgaaacctgcgtcctggccctgggcatcagggctggccctgccctggtgtcctcacacagtcacttctgtgtgcggtccgcgtcctcaggtcatgaggaaggtcaccctgggctaggcccacctttgatgtcacggtcacctcacttatctcttcaaaggctctgctgtttgggcttccttccattggctttggcagggcaagcctggctcctaacaccctccgtttgttggagctctcaggctgcctctggggaccgtctgccaggacacaggccacccttgctgcctggttccccactccccaagccactcacctggcagggcgtgactggcacttctggcctgagtgcctgctgggcgcccgcccctagccagttctgtcgtccttcctttccacccaggacagccccgtcctgcactgccgtgtcgcccactgccggggcctctctgggaccaacaggcccccttccttccacccaccaggccctaccccacctggaccctctgaaatgttcctcgttgacaaatggtcttgcagaaggcaggatggctcctgcagcccccactcccgctctgtgggtggatgccccgtctctccctgcccaggcaccgtggtgccttctctctcccgggcaccgtggtgccacctccctcccagacaccatgatgctgcctccctcccgggctctgtggtgccatctccctgccgaggcactgtggtgccgccttcctcccgggcacggtggtgccgcctccctcccaggcgctgtggtgccgcctccctcccgggcgtcttgagctgcaagggctcctctcttggcttcgttccccggagggtggtgctgttctcgttggagggggcggccaggcgctgggccacgtgtgcatgcagcccctacagagttgctgccccgtgggggttgacgtgggcctcctttcggaagctcttcctggcaacactgagtggggcaaggggttggcagcagagaggcggctggatttggggccccagtgtcctgggcggcagctagggaggggccggctccaggccctcaggctgtgtcagggcagggcgggcacccccacttctccctgtcagccgagggagccaggcaggggcagcctgagacatcctgggacagtgctggtggggagaggcccctcagcctgtgcctccctcaaaggcccttcccgggccctgctctggctggggggacggtgtgacccactttccctttccagccccagcttggtgaccgggtggctccattcaccctgggtccctcgctgaaacggtgcctgggaccagagcagagaacacgcttgccagtggtaggagatggaggcgacgtggactctgggaggcttcttttttggggtccatccagaggccgagcctctccaagcactggtcagcctccatgccacccagtctgccgaccctcctctccaccatcccctcgtccgagcagtggcgatccctcccgagtcaaggctgggcacaagcacgtggggacaggccgggtaggctgcctggctcagtgctccctgcacagaggcgcagacagggagcccaggtgccccaggcctggctgccaagcctacttccctctcctggtgttcccgagtcctgcccgcccctttctgtgcgtcccgtggggcagtgctggttgggggtcctggcctgtgggggctatgatgagaaccaggtgcctctctgcatcggtggcctctgagggagccctctcgcccggcagcaggtgggatgcagatggggctggccagggctcctgtgcccacagcagcctctgggcagtgtaccctgggcttctgtgagcagccgcagcctgggtgtgaatcttggaggcccggtggtggcggagcatgctctccatctgggagaggctgagaccatggcagctcctggcgctgtcctccccgtgcccccttcctggctccccagcttccggcgcctctccagggccactcgggcagcccctgcccaccccacaggcccttctctgctcacaaggctttgatcccaggcggcacaattgggttttcaaagcattcacggcccttgtttgtgtccctgggcccccggctggaggctgaggtttcggcgttcctgggcctggcctttgaagcttcctcttattaatcttttaacatcccccagccccactcccacccccagcctgtggccctgagcagcctggagccgggagggggaatctggagctgggagggggataccccagcctggcagctgcacccctccacggtggtcccggcgcatccgccaggacccgccacgcctggccccaccttcctcgggtgcagaggccagaggagggaggacggtgatgctgcatggcttgaggaccctcgaggccccagccttcagctggcttggggcttggggtggtcccatggagggcgctggtcccaggacgccctggccttgcttacaggggtagggctggtgtcagacaggaagctgggcgatgggctcatgggggccgggcaggcagagcctgtctgagggtggagctggggcctggccctgggggtgtagctgccttcacagcaggggggtgctctgcccacacccggcccctgagccccccgccctccctgcaggcgaacctcttcccggccgctctggtgcacttgggagccgaggagccggcaggtgagtgtcagtggttggggccagtgtcggagtccagccagcctgtccctggacctcagagccagctgcccgggagggcgttcggtctggggcctcctttgggtctgagagggagatctgcggcccccagtaaccacctccccgagagaggactgggacagccacctgctggccacccccctcccagagctgagtgctggtgggcagatgctgggtggatggtgagtggacccctcctcagaggctcagggtgagcttgggcctccctgcaggtgtctacctggagcctggcctgctggagcatgccatctccccatctgcggccgatgtgctggtggccaggtaagtgccggtgggtctgggggcacctcccgtggcggcactcaccactctgtgtcttcgcctccccacaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccgggtactgcggctgggtggaaggtggggtgctgtggccgggtggagggcgggggtccgggtgctgtggcagggtcagtgggctggggggctaggtgctgtggccggcagggccgagtgcttcagccgggctggtgggcgggtggccgggtggtgagagcccggggtgtgtggtcaccctgatgtgtctgcactacagccagcaagaggtgagagctgccagcctgaggtgcccactccgccagccacaggaccacctcctctgccagcaggaataaagacttgtgcatccctcaa

SEQ ID NO: 707 - DNA, 39858 bp, Homo sapiens; identical to SEQ ID NO: 706

SEQ ID NO: 708 - DNA, 7590 bp, Homo sapiens
gtacgtataaatgtcagcatttatttcctgctcaaggacgtcaatggggcccagtcaatgggctgaggggctgttgtgccactgcccacccggcttggactcaggggtggccagtgggtcagctcctggctggaccaggctgggcttctgtgcaggagaagctggctggagcctggaggatgatggccccggcgtcaggagtttcggcaactggacccttgagcagaggcaagcagtacccagattctgtgtccagcggccgccctcagccgggctccctcccagtgccacagatgcccacagtgcacagatgcccgccgggcactgctgaagctgcttcgtcacagccaatggtgagtgtccaggtggggctccgtggctatggcggaaccaggtcctccccgtccactgtgcactcggtgccgccgggctctgcaggctcttccaggccacccgcgccacctccagcctgcggagactccggaggaagcctgcttccaaacactgtggctaccagcccagaggcttcccggacgtgggtgggagaggctggtccagatttctggctccttctctgtgagctggcacagctccccaggcagggctctcttcccagggttctgggagctgcctctctgaaccaggagtggttccggctccccacgcccctccctccccttgcctggcccagctactctcctgggttcgtctcctctggaagtcattcctctttcagcttgccttacccagcctgactgtggtctccagacactaatggaggtactgggtgcctcgcaaatgcttctagcctccatgtccccagctgcaaaatgggtcacaacagcagctgctttaaagttttcccttatgatgttccagtgaccagcactgagccccaggagcgctgggaaatggtgagagagagtgagttggggattggcctaggtgaggctctcccctgcgtctgctcagggcctctgccctactgtcctgcccttgtccctctgagcccagtctggaagtcggggagcgacctctcccgttgtacttcatctcccctgagcccgcggcttccctcctgctcgctacttgacactttggttcacctgagtttccctcgcagagcctggagctggtggccagagagcagaggtgggtgggctgccactgtgggctacaggctgggcacgaagcgaatcctctgggagtaggcgaggtcaacgacgtacaggagcaggttgacgtaggtgaagatggccaccaccagctggctgtcccagggacagctgccccgagcacagttggggggccgtttgggctcaccgtacttgggatcgaaacagaagactggccagatcacggcggcgctgaggtacaggagcacagccaggaaggtgtacaccaccaccagccagtcaaaggggcagcccaggccccctgtgtggcccatcacactcagggccaccacggccactgtggccaggaagcacaggctgtagacggccacgcaccactgggtggccacgtagcgcccgtagcggctgtcatggaccagcgccccgaagatgatgcaggccacgaaggcctggacgatcttgaggagccccgacaccgtggccatatagctgctcacctggccgggccgggcccgcgtcagggccacctccacagcgtaggccaggaagaggagcccggcgaagacactggctgccaggcggaagtccctggcagcacagccggcgggctcgggggaacactcccgccgggcaaagtacagcggatacaggaccgcagccgtcgcgcatagcagggtggccagcatggcgaaggcggcggtgaagttgccccaggagagccgcaggcagccgtggagccgtgtgaactcacaggccaccaccagcgcagagacggcgaagcagaagccccaggcggccatgcagaaggtgccctggacgcccgcaaagccaccccggtgggccaccaggctgaaggtagtgcagccaaaggccagctgcagcacgcgggctgtgcccacaggggatgtcacggcgcccaggtgcaggtacgcacccccagggggctccatggtgctgcccatctggccagccacgtttccagctcacacagtcccccaaggccctggggtccctgctgggccaaggcccctcagtcctctgcggtagtggcaggtgcctgcagcctgcagaggcagtgacgacggtgacattgcagcagggcagcctctctgctgtctatgtgaggcggctccccccagcgctataaatagacagccgtgatcagagccccggaatagcagcttgcgtgcctgtccccatcttagagagacatctgacccctggtcccctgtggagcccctgccgggaccattaacccattggctgctggcaccacccccacctccgcctcccgcgcacctgcatctgtcaatccggtcagttggtttcacgcttgtgggggagggggagggagaaggaggggagcaaagagcatgagggtccccacggggtaaccccagctccagcagcctccagggccagctgtgggggggaggggtgtaggaggcaggaggcggcagcctgggctcctggggctcgcgggggtcggggatggtttccccaacatttatctcaccccttctggatggccgcgtggttcagagcctgcatgggcttcaggatcctgctgtcattgcctggggttcacagggttctgctgcggccagaggagcagagcatggagaccgtggcctctgctccccgagccccgctccccaccctcattctgtctcgtccctaacctgcctggggcagagacatttgactgttagttactgttactgtttgcaggggccattctggggcttttcacttgtccttcacattaaacacctagaaaaacactcaactcttccctttttttttgagatggagcctcgctctgtcacccaggctggagtgcaatggcgcgatctcggctcccaggttcaagcaattatcctgcctcagcctcccaagtagctgagattacaggcgtgagccaccatgcctggctaatttttttgtatttttaatagagaccgggtttcaccatgttggccaggctggtcttgatctcttgacctcatgatccgcctgcctcggcctcccaaagtgctgggattataggcgtgagccactaggtccggcccctcttttttttcgagatagggtctagctttgtcgctcaggttggaatgcagtggtgagatcacagctcactgcagcctcgacctcccaggctcaagtgatcctcctgcctcagcctttttatttatttacttatttatttatttaaccacttgcactcacttccacctcttccatttttaagctaaaatatgaaatgtttttaaaaaggaaaaaaatgatatctttttttttttttgagacggagtcttgctgtgttgctcaggctggagtacagtggcgtgatctctgctcactgcaagctccgcctcccaggttcacgccattctcctgcctcaacctcccgagtacctgggactacaggcacctgccaccacgcccggctaatttttaggatttttagtagaaacggagttttaccatgttagccaggatggtctcgatatcctgacctcgtgatccacctgcctcggcctcccaaagtgctgggattacaggcatgagccactgtgcccggccggaaaaaatgatttcttactaatttttttttctttttttctttttttttttttgagacagagtctcgctctgttgcccaggttggagtgcaatggcgcaatctcggctcactgcaagctctgcctcccaggttcacgccattctcctgcctcagcctcttgagtagctgggactacaggtgcccgccaccacgcctggctaattttttgtatttttagtagacacggggtttcaccatgttagccaggatggtctcgatctcctgacctcgtgatccgcccgcctcagcctcccaaagtgctgggattacaggcgttagccacctcgcccagctttgttactaaaaagagaaagaaaaattgcctgtaattccatcacctggattcaaccactttgaacatcttctggtatatccttgtatgtatttcctggactttttagttagaaaaacttaaatccagccgggcgcggtggctcacacctgcaatccgagcactttgggaggggctgaggtggatggatcacgaggtcaggagatacagaccatcctggctaacatggtgaaaccccatctctactaaaaatacaaaaaaattagccaggcgtggtggcacgtgcctgtagtcccagctactcaggaggctgaggcagaagaatcgcttgaactcaggaggcagaggttgcagtgagccgaaatcacgccattgcactccagcctgggtgacagagctagattccgtctcaaaaaaaaaagggccggacgcagtggctcacacttgtaatcccaacactttgggaggccgaggaagacggatcacaaggtcaggagaaattgagaccgtcctggctaacacagtgaaaccccgtctctactaaaaatacaaaaacaaaattagctgggcatggtggcacgcacctgtagggcagctcccagctcctcgggaggctgaggtgggagaatggcgtgaacctgggaggcggagcttgcagtgagctgagatcgcaacagagcgagactcctcaaaaaaaaaaaagaaagaaaaagaaaaagaaatgcctactgaatctctgccctgggtttctgagacagaacttctaagaccctttcagacagaggcaggaggagtcttttattgtggtatttggtctttgaccccggttcctgacatagagctcctaaaacctttataatctcctaacccataggatcatctgacatggggctcccaatccccttgaatttcctgggtgacaggagcgtcttttgttctaatgaggcgactcctggtgggctcctggacagccttggggtggggggttggtggcagctactatgtgatcagaagggcagagcttctagccccacttgcagcctccaggagggacaggggctgaaggctgagctgatcaccagtgaccaatgatgtaatcagtcatgcctacgtaatgaagtctccataaaacccaaaaggacagggttgggaggtttccaggtggcggaatgcttggagggtcctggaagctccctggagaggcctccagatgaacagcattgcctctatctgctgttcatctgggtcctttgtcacacatggggaaacataaataaagtgttggcggagctcggtggctgacgcctgtcatcccagcgctttgggaggctgaggcaggcagatcacttgagctcaggagttccagaccagcctggccaacatagtgagaccccatctctacaaaaaatacgaaaattggctgggcgcagtaggtcacgcctgtcatctcagcactttgggaggccgaggcaggtagatcatttaaggtcaggggtttgagaccagcctggccaacatggtaaaactctgtctatatttaaaaaaaaaaaaacaattggccgggcgcggtggctcacacctgtaatcccagcactttgggaggccaaggtgggcggatcacgaggtcaggagatcgagaccatcctggctaacacagtgaaaccccatctctactaaaaatacaaaaaattatccaggcgtggtgatgggcgcctgtagtcccagctactcaggaggctgaggcaggagaatggcgtgaacccgggaggcagagcttgcagtgagccaagatagtgccactgcactccagcctgggcaacagagcaagactctgtctcaaaaaaaaaaaaaattggctaagtgtagtggcacatgcctgtaatctcagttactggggaggctgaggtaggagaatcgcttgaacccaggagaccgaggttgccgtgagctgagattgcaccactgcactccagcctgggcaacggagtgagactccatctcaaaaaaaaaaaaaaaatgagttgggcgtggtggtgcacatccgtaatcccagctacttgggaggttgaggtgggaggactgcttaatcccaggaggttgagggtgcagtgaactgtgattatgccgtcacactccagcccgggcaacacaatgaaaccccatctccaaaagtaaatcaataaataataaaatgaggaaagtgcttccctgagttctgtgagccactccagcaaagtcacaaaactggaggaggggccatgggaacctcggttggccagagggcgggtgacacctgctacatttggtcatctgtcctcaggttccacacccaagtattcaacaaacctcagactgaaaatacaaaaaatactggcccggcgcggtgggtcacgcctgtaatcccagcacgttgagaggctgaggcaggcagatcacctgaggtcaggagtttgagaccagccaggccaacatggtgaaaccccatttctactaaaaatacaaaaattagccgggcgtggtggtgggtgcctgtagtcccagctacttgggaggctgaggcaggagaatcgcttgaacccggaaggcagaggttgcagtcagccgagatcgtgccactgcactgtagcctggcgacagagcaagactcagtctcgaaaagaagaaaaggccgggcgcggtggctcatgcctgtaatcccagcactttgggaggctgaggcgggcggatcacaaggtcaggagatcgagaccatcctggccaacgtggtgaaaccccgtctctactaaaaatacaaaaaattagccaggtgtggcagtgggcgctggtagtcccagctactcgggaggctgagacaggagaatggcgtgaacccgggaggcagagcttgcagtgagccgagatcgcgccactgcactccagcctgggcaacagagcaagactccgtctcaaaagaaaatacaaaaaataaataaataaaacaataaataaggccaggcgcagtggctcatgcctgtacatccagcactgttgggaggcggaggtgggtggatcacctgaagtcaggagtttgagaccagcctgaccaaccaacatggtgaaatcccgtctctactaaaaataacagaaattagccaggcctggtggtatgtgactgtaatcccagctactccagaggctgaggcaggagacttgcttgaacctgggaggcggagattgcagtgagccaagatcatgccactatacttcagcctgggtgacagagggagactccatctcaaaataatagtaataataatacaaataatacaaatttaaaaagcaatactatgtaacaactgtttacatagaatttacataccaggtgttataagtaatcaagaggtgatttaagtccagaggagggggttatatgcaaataacatgccattttgtatcagggactctggccttgtggattctggtgttttggaggtactggatcccatcccccaaggatacaaagggacagctgtacttgggactggcatctgaag

SEQ ID NO: 709 - DNA, 1818 bp, Homo sapiens; identical to SEQ ID NO: 702

SEQ ID NO: 710 - DNA, 39858 bp, Homo sapiens; identical to SEQ ID NO: 706

SEQ ID NO: 711 - DNA, 2550 bp, Homo sapiens
ctgtctccggccgatcgctcggcgctcgggtccgcggccgctgcggcgccgggcatttctccgcagctcggctcgcggccgcgcccgccgccgcccggcccgcgcccatgcaggccatcaagtgcgtggtggtcggcgacgggtgagtgcgcggcccggaggccgcttggctgggctgggcgggaggggggctcgggggctcggggcgcagccggggcggggcgggggtggcgcccgggtcctcgcgaggcggccccgccgtaccccgcccgagccgcgtgcgccccggggtcgaggagggcggggtggggcggggcggggtccgcgggcctccagctcgggcccacctgatgctgcccggctcccgcttgggctggctgcgggcgaggcggggccgccgccctgtcctcccagtgggtggggccaggcctctcacctgggctgaaccctcagccggccccaccctctcctgccgccaccctcggagtcggggcctctgcctggggccccagtgtggggcgccctgcgcccttattcaccaccccagcccccggagcccggcctgcccaggtcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtgtgagtgtggcatgggggggacacgggcagggtctcctctgggcttccacgtcggctcaggtggccctgtctctgggcttcccggctggagctgaggtgctggccagagttctagttctgtgcagacttgtgaaccccaagacacaggccagcagggctgggggtttctgggacccctcccaagccctgaccctgccctcactgctctgcagttttgacaactactctgccaacgtgatggtggacgggaaaccagtcaacttggggctgtgggacacagcgggtcaggaggactacgatcggctgcggccactctcctacccccaaactgtacgtaacaatggggccagccccgggagctgggggggtccctgagatccgcacaagggagggagcagggccctggggagcccctgaccactccaccaggtcccacctttttcccaaggacgtctttctgatctgcttctctctggtgagcccggcctccttcgagaatgttcgtgccaaggtagggcaaggctgggggcccctgtggggagagggcttgccccagtacctgccccgacaagttgtcctttagaggcaattgcgatacgggttctgcctggggtaggcacacggagtggggtctgaagatgaccatgggggctgatggggtgccgtggtggtggtcacagctctcagaatggagggttctgagggctctggctgctggggatgggccttgactaggaggccctgggaggtctccaggttccctggctgcgtgtttgttcctggtatctccccaccaaatccgcccctggtcaccccttgaaggaagaagagccaagtgtagctctggaacagtggggaaagtccctgagggccgtgacttgctcaggtggggctggggtagccgactccgggcctagggatcagagcgtctgtccctgcagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggtgggtaggcgctggcggcctgcaggggaggggtggggaggcgcagtaagggcctccctgtaccccaccctcactgtctcccctcctcactgccgctaggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctaca

SEQ ID NO: 712 - DNA, 5302 bp, Homo sapiens
agtctctttaaaaggtttattgatcatatacaaaataaagaaaaccttatatatcacaaacatacactatgtacagcaataaatacccggggggccaggcccagtgctgcccctcctggacaataatttagcaataaatactgcgcagggcaggggtagggcaccaaggccactgccctgcaagaggtcaggcccctgcccgccctacacgaagtgtgagcgctcgggcctcaccccgcatccaaaccccagcccctcctcacttagatctttaataacctccatcccaccccagcagatcccggggtcttctcccacacacacaacctcccctggctagacctaggcagggcaggcagggactgatcaactctgcttggacccacctctcagcgccaggagagcaacagggctggacacgcgggcagcccttgtcctgttgccaggagaaggctttctgtgcccactcccgtttggttaaaggcttcagggactagcagattgagggggtgggaagaagggcagggctgggacacaaggttgctggaggggccaaagcccaactggggtcaccaagaacagggaggtctcacagtttatcggggacacactctagctcagactcaagggacacccatggtatcaaagctgctgctccaggggcagggtggaaatgtgtgggactggcccagcaggtatggtacacacccaggacacaggccagaggcaggacaggcattagtctctcagacacgccctgcctctgtgtggcactgattatgtactctactctcccgacctgctccaaggccagacagccaacaggaaggcaaaaatacaccaaaaagaattattcagtggcttctgggggaaaaatcgttaatgtgttggttcctttcaccaaaccacagcctaaaaaagtaactcacaagatcccagagcggaaacggtgcagcaggctgcggctccgactttccagatgtggatgggcgctttggccaagtggccactccagagggaggcagcagggacaacatgggacctgaccatcgtcccaaagcaggctgcagccgctcagggccgtgggccgggccctgatcaccagtcagaagtgtacacacatatctgaaacatgcaccaagagctgagccagcaacaccagtgccaccccgagcagcagccaggggcctcactctcctggtgagagctgacctgtccctgctgggtattcctctgaaatctgagcgtccatgttaggataaaagaggagttggggcaaagttaaggtggaagggaagacatatatcatggtttacttggcggacaagtttgagagacctggccttggccaaagccctcgattcgctgtgtcagaaaaactgaggtgagaagagaccaccaccctctccaccaccctctcagtaggaaagcgggatcaacagagatcagaaggacagcacactcacacctgcacatgaacacaccatctatgtcaggaaatccaggggaaggggaagaggggtggagtggctccgcagggctgacctgacaggggacaggaacactcccctagacccagggaagtcgccccaaatccaaagctcttgaaaggaggtatggcctcgaaactccagaagcctcttctgccaacgcaccgaggacctgcacctcccattcagcacgcgtcgacccttacaccctcctcttccacactcccttcgcctccaggtctgcagcctggcagaggtgctcaaaatggatggccacccacagccaggacaaaagtgggggctgcacaaggacaaggagggcctgtttctccccactccgaggcagatcatgacgttttcttcatggatacttatgatatgattccaactaacgcctggattctacttagacaagatcagactgaggggagggggatgaagtcactaaatgacaagagtcaacagccaatatttccattttcaggctgacgcaggtagacacaggacttgtctctgaacacctcgagcaaagaaaagctcattaacatgacaagtgttgatggtgcctccctgttcccatcctgtgggcacaccaggccaaactattggataaaaatcccaccatccatagggttaagccctgttgggccacagtttttcatcttacccacatctgtgtgctttacagaagtctgggccccacagaaaagaaaccagcaacccggtgaaaggccagggctcacatggccagacacagggctgtagcctcttggaggtgggtaggggcaccccctccccatcatatgcctacaaggagcctcctgagcccagccaggaagggcagcagcctctggcgaggaactgagagcaggaggcaggctgcgcccccacagggaggcacctccagcagaagccaagcagctgatccctggaagacacagatcccaaagggaggcagaaggcaggcccgaagccaagagctgccagcgtggaccagcggagaagagggacaagacccggccctggagactgtagcccttgtctgcactggtggagacccccaaggctctcagagtgaggcagggacaaggaagaaagggcggtgcccggtgggcccccacccactctgcctggaagcaccacccgcagcatggaaacacctcagggatcaagcgggcggcgagacctgcagcccacggcgcgggcagcctataggaacaaagctgaggccagaggaagacggccagggaacgcttggccatagccctgtggccacccacagtgactccctcatccctgtaatgccaccacccaaggccagaggtggtgggtgtggaagcagcgtggggcgccccaagggaccccagtttcacctaccccgccactagatcagcccaagccctagacacagatgtagccaaggctcagtggaggggggcatgacagaaccccatgtctcacctcctacggaccaggagctggtggtgggcacagattccttgagctctgacgcagcaggcgccacttggcaccccagcccaggtccagcaagccagcagaagcaaaagcacaactaaacccaaaaaacgaacacgggaaaacagacacaagaagtgacacccacaggtcaaaggtcaccagaagcaccagcactttaccgctgcacaaaacctcaccaggcacggacgacaccacggcaccggcaagagacggaagcaggaagggcagaggagtaagtcactttcggtacaattgcaaaagatatcaaagaggacggccttctggtcggctcacggcttggcttttttttttttgtcttttttttaaactaagttttataaataatgtctgataactctgtgtatataaaaactaaactccaacagccacaaagaggtgtccgtaagtttacaagaaagggattttttttctttttttttcttttttttttaactagcaaagtttctattatactttcttcccttttccattcatatggtcaaatggtcttcttgcttgttttttttctaaaagacagttttataaatactctgcagctcttttttctttaacttttaaacatataattaatttaataactttgtaaaaggaacttctctcttttaaataaagggctatataaccacacaaataggtcatgtaaacagtgacacgggacccatcgcagggcacactggacccaccctcacgttaagcgcacaaccagcgatttggtcttgttcagtgcaacgggtcaggcctgagtgcacagcccctgggcccagctgcacgcccccagcaccactgcgcccaggctggtggtccacccatcagggccttcaagcccgccctactctcagagcagagcccatctcttcatgctgggctaagctgagctgctcccctggggctaaagagagtgaatccttcccagcccgcgagcctgtggccactcgggagtggagggaacactgggaccctcactgctcggggacacgcgaggcccagcgtgcctgctccttctctctcccgcaactctctctagtccgttcccacagcaccaactctggactccaagcctgcatggccctggtacaaaaggggttggggcgaccccacgtcaccgccgaactgaccaatcccaacatacaaaacacacgacgacaatgacgagatcaaaggggctcagcccggcgcccctggggtacaggttgtgctttgcagggaagagagaagggtggggaagagagggaggaaagagaagagaaggaaacagagggacagggcagccaaattcgccatgtgcctagtggccccgcaaagacccgcctgggcagacgcgcgtccctacgatcgggcatccgtcttggactttactattgtgatgacgctggtggcggccaccttgcctgggacgaggggccccaggccggcggcaagggggccccgggctggcgccacggggctgcgggccaccgtccgggcgaaggtctgcagcgcctcgtacttggagcgcagcgcgtcgagctccagcttcatgctggcgttctctgaggccagcttctccacctcctgctgcagctccgccttctgcttctccagctcctccttctgcgtcacccgcttcacgcggcagctggcagcgtagccgcggttcttgagcgtgcgccggcgctgcttcagctggacgatctcctccttggacaggccccgcaggtgctggttcagctcccgcaccgacatggtcaccagctcctcatccgtcaggctggtgccattctcacccggctcccgcttcacctggggcacagtgcaggtggtcacaggccaagcgggcacgcccactgtgccccccgaccccagcccacaggctcctgtccctgcccactcaccttcaaggccttgtttcctttattgggggtcgtcataacccgggggcacagcgagcaggcgctctctgcaagacacggagcaggtcagtaccctggagaccaccctcgccgcaccccccccccccccgcccccggcccagttcacaagagcccttgccgcacagcccgccccagcctgctgtccaggtgcccagcccccaatacctgataggaggcagcccttggcctctcccaggctgggctgagctgcttcctgtccaccctgcccctagagaaccaggtgggaggtcaggaaggtctgacgggagaaggggaactgaaggctgttaggaaggcaggcgcaagacaaggggcgggggagagattagaaggaataagacgcgggagaggcaggcctagaaggaagccgggagctttaaa

SEQ ID NO: 713 - DNA, 4208 bp, Homo sapiens; identical to SEQ ID NO: 699

SEQ ID NO: 714 - DNA, 3874 bp, Homo sapiens
gtgaagtaagaacaaaagctttactcgtgctcggcaacagcaaagcaggaggcagaggggagatgacggcccctgtcccatttccctccatggaaggcaccaggcggggaggtgggtctgctgggatgggcaggtcagcggaacaaaaggctcctgttgtttatgggcccaggcacagtggggcaggagcacgacccagaaagtagtcctgagccacaagtcagagcggagaaaacatctctgtggtcccagtcaagaggcctccgaatgaggcgcctggactgggagcaaagctctggtcgagaacatgaccttcccgggcctgagtcccactgtggtgcccggccgtgcacccagcctgcggcagagagggcggcgtcccccacaaagcctgccaggctgagcccttgcaatggccgtggctgggccaggaccttggcctggagcctgctccttgacacccagccagcctagcacccgccttcagcaacaggtaatggagcccggatggcagctccctcccaggtgcgcaagtgctggggtggaagcctgttcccgtgggatcaaccttggggctgggtcggggggaggggcactgcggccctggccatcagcctggctgtcttcgttctcccaaaacacccatcaccgcagcccaccaggggctgggagagggggggctgcaggctagccagagggtctgccaggtgcctgcatctcactggtgtggccgtggcacctgagggagcccactgagcccatagggggctctggttccccgcgcctgggacagagccaggcagccctgggtcggggtggttggtgtcaccgagaggtcggggcgccctgtttctgcctgggacaccagtccgtgtctgggtacagaagacaatggatagacttaaacctggggaaggaagaagtaggggtcagggccgtgggcggagagagaagcgggggccagggccgtgggcggcgggagaacctggggtcagggccgtgggtacagggagaagccggggtcagggccgtgggcggagggagcagcgggggtcagggccgtgggtagagggagctgatgccagagcccctgcggggccgagggcctgcccatgccactacctactcaccgtgtggggtcttgatgcaggctgaagcctccagccacgttcaccacgttatgtgggttctcaggacccccatggctcaaggtaacctgggagggaagggtgtgggcagagtgtgtggcctggtctggtctcgggccacgcctgcccctggccaggagccctgctagagcccctttgcccaccccctctccccaggccctcggggaggccaggcttggaaacagcattgaagcatggcatgagctgagtagggggacacctcaggcagagcctgggggacagaagatagggatctgaaacctccagggcaaagctgaccctcattccctccctgctccacgtgatgggacctgttccgactcaccatcaccatacacaccacacccactgcccagctggcatggggcctcactggcccgagaactgtgcttctcccctcgttcctctgccccagacaccataccccatctgtacgtgaggaccctgtgtccaacaggccaaggggcctgtccagggtccacccccagccacatgcaaatcccacctgcctgctcagccgggcatcgggccggggcagtggggcccctgggggagtcagggcggggcaaagcccaggtggcagaggcacccagagtggcgcctgtacctgctggagcagggtgtcgggcggcagcctctgcaggttctccaggtgagagtggaagagggggctgtgcagcaggcgggcgcccaggagcccctccacgatgtagccaactgtgcagtcatccggcagccgcacctgctcagctgtgctcatgaagctgcccaggctggggggaggccggtcagcacctttcaggtctcagcctccgcctcccagcccgggcagctggacccccactcacctggcccatgggctcatcttgagggcaaggcctctgctgaggcagaacccggccccaccagtagcaaaccagaacttgaccgtggtcacctgaagatggggtggtggtcagagctgcccaggacagggcttctcacccctgactcttcatgggactccccaggcatctttcttaagctgccccttaggagatcccacccaggtaacagaagcttcttggagcaaaaagagccgggggcttctgcaggccattgacccgtagcctccagaccctccccacctggcccagacaccccctctctgcccagtacggtgagggcctcctggcctgctcctgaaacaccacatgcaaaccacctgggtggatcagcttgggcccccaaccctatgcccttctcaagccagctttccacgccctctgctgtgcctcccgggctggtgtcaaggaaggcgtctgctccgatggcgtctgctccgacactcacagttctgccaccctggaccctctcggtggcctcaatggggtggtccaggctgggccgccccaggtagacgtcctggctgggtgagaagctggagagcaggtgcaggaggctcctggcgttcacataattgtcatcatccacgtggcaaaaccacctgtgggcgaggggagtcctgggcacgagggcctggcatggctggacaggaggcccccacccagcttggctctgagctctctgcgggtcgggtcagcgccgcgtacttgcgcccggactcaatgaacttgtcatactccacggacatcttgcagcagagggcctgacgagtgcgcaccgccgagcagttggtgttgatgacacggtcgcctgcgaatcagagacgggaagcacgcacgtagaggatggcactggggttggggtaaggcctgtgccccacctgcccccaagggccagggcacaacgtggctgtctgacatgcctggacaccttgcctgggtccaaccacagccctagccctcacgcgctgaccctgctggtgccaccgaggctgaagcaggcggccatcggttgggatctcttgagtggaaacaggacggaggcagctcgccctgacctggcctggaagggcggattccctgctggcgcttcttcaggggacgtggcactagccccacgccccgggaagcggctagtgtgagaggctggtggggagcagagcttggctggcagggtgggccctccgcaggccgcgtgacctgggcagcgtcggggcctccccgggcctcgggagcctgggcagagaaaggcacccacagcagcgaaggggccgtggcttcggagcgagaaaggctcggggggcagatcccgcgggcgccggggagtgggggacactcaccgccctggagctcgagctcagggtcgtccccgtcggtgaagataaacgtctgggggagaaacaatctatgaggcttctggggcgctgcccaggccggagaccgacccgccccgcgcggagcctccgggggcctgggccgggcctagaccctgggaggcggggcgggtgggcgtggggctcgccgtcggggtcggggtccggcgcacctgctggcgggcccgggagatccaggtgcgcagcagcagccgcaggcgcggcccgtggttcttccgggtggtcttgacggcgatgaagacgtcgtcaggccgcaggctgggggcagcgggccgggacgggggcgcgcgcggggccggggcgggggtccgggccggggcgggcgcgcggggcagcggcagcggcagtaacagcagcgcggccagggccgcggccagcgcgaggcaggcccggcacagcgccccacgcgcgcggctcatgcggccgc

SEQ ID NO: 715 - DNA, 19894 bp, Homo sapiens
gtggagatcacatgcggtttaattgtgggaggctgagagcagcatttttaccaaattggtgtaaaaatgaaacggggtccagacgtgtacactgacagttacagtaaatttcaaaatccaagcagcaatttgaatcatttcttgaaaaacaaacacagacaaacaccaaacatggagttggtgcccggcgccgggcataagggcagcaccccacgggtggctgtgcggggggccgctgggtgtggccgggccctgtgtgcctgtgcaggggcccagctcctcggggactggcccacgaccccccactcagcgggctgagccaatgcctggccgagagggggccgcagccagcaggcttgggtggctgcccgcgcccgcaggggacatcggggaaatgggggcagagtgcgggacccacacgctgcctgaggagtcttggcagggtggacaggcctgggggtctctaccagcaatgcaataaatatgcaaatccaagcacagaaagaccaagcgcagaccccacgggcgcacgaggcccagcccagttcctgcgggcacgggcaccaccggctcttcacagaccaggagtctccaagtcggcagctctggtgtccccgaggtgccgtgggaggcggcgggtgggtgggacatgcctaacacctacatctagcagcctcggggggcagtggcactgggccggacagggtcccaccggcaggacccttcaatcccgttgcatggcgggggtggggtggggtggggtggggatggtggagtgacctccggtggcaggcgggggcacgggcctagccctcccgcacgctcacgcgtggctcagccagggagctgtggatgatgctgatgatggactccaggccgctgccctccagcagcgtgcggtggtcaccctcgatgacgtggacggatactttcccgtcgcatacctgcaggggatgcgatcagctgccgtcccaccccactcctgtccctgtccccgttcccgtcaggccccttgcgcacctgggagaggttgtagtccgcgcccaggtcctcgccgtaggcgccacccgtcttggcgcgcagtagcatcacgttgccatggtacttggccttgggtgtgtactgctcagcggcacgcagcttgtagtagaaggaccgggccgcaaagctcagctcctggcggtccaggccctggtggctcttgatgatcaggtccacggcggctgccacacgctcctctaggcccttcagcggcagcagcgcctccagcacctgtggggtcgggctctgagcaggtgctggcagcacccacagcaccggcctgccctgtgctacactgcgggtgggctttttttttttgagacgagtttcatttttgttacccaggctagatggagtggggcgatctcagctcaccgcaacctccacctacccggttcaagcgattctcctccctccgcaacctccacctacccggttcaagcgattctcctcccgagtaggtgggactataggtgagtgccaccatgcctggctaatttttgtatttttagtagagaaggggtttctccacgttggtcaggctggtctcgaactcccgacctcaggtaatctgcccgccttagcctcccaaagtgccgggattacaggcatgagcaaccgcatccggccgggatcggctattaaaggggtgaagttggggggcctttaacgctcttcgcgtcccatcccatccttcccttcccccttccgttcctgcccagtactctgggtcctgcggcctcaggggtgtccaggacccaccctgttgtgctccatgtccgtgaactgctgcacgaagaagcatatggcctccgtctcagcctcagcctcacagcctggggtcagctttgcccggtagctctgagaggaaggagggactgctgagcagatggaaggggcggggcctcctaagcgacggtcccccaaagccagggcacaggtggggagcccagacgtttgccgtaggcctctaggaccagcctggctctcacctgggtgtaggccagtacgtaggtgggcgagccgtcgaacaggaagaggctgttgtgggtgggggctgggctctgctgggcctgcagctgggagcacatttcaaaggccacgcaggccccgtaggagtagccggccacgcggtaggggccctcgggctgcacctgcctgatgcagtcgatgtagtaggcagccaggctgtggatgctgtcaaggggcgcagctgcaatggcagtgccgggcactcagcatgtgcaggcggcagccacgggccccgtgatggccagcactgaccaccgcttccagaggagggcccgggagtacctcgggtgcactgcaggccataggtggggatgctgagccgggaggccaggctgtggaacacggtggtggagccctcgattgggtgcaccaggaacaggggccgctccgagctctgcacggagttgagccgcatcagggtggggccctccgggttcaccagcagggagcgcaggttcagctgagtctgctgctgggccagaccatcctccttgggcgtggggcatgccagctctgtgaagacaggggcagatgccaggctggtctgggtgcagagccctggcacccacgcaaggacacacagacacgcacgcaggtccccacggtgctacgtcaggtgggagtcggggtgggaacgctcagaatggcacccgtgacgaagggcggtatgcctgccgggacacggtccagacaacaaggaggaagggctggggaggcccggggaccccactcccgcctggccacccacacgcaccgctggcctcatccgcctttgaggacagctcctgcagtttccggagcgtgagttgccgcacctcgcgcacggacagcaccaggttgagctcacgctccagcgtctggcgcacctccacgctcatgagcgagtccaggcccaggtccgccagtgagctgtccaggttgacagcagccaagtcgcggatgcctggaagggatgcgccgggtcggcaactccagagggggcatggggacggcctgtatgcggcagggctgacacccaggggtgcgtgggctgtgcatctcccaaagcaccaccaccacagtgacacctgcgcccgcaccctggctctgcagatggggaaactgaggcgcacaggggcacgactgctatgtcccaagaccctgatgccagcaggggaaacacctggcgcggctcctactgggagtgctcacccaggatgtgtgccacggcctccaccaggtcccgctggctgtccctgtccctataggccgcagccttctcagccagcacaaagctgctcaggaccatgtggggctggttcaggaagaggtccagcacctccaggcaggacgccatgcgctggggcagcgtgccactgacgatcgtgtcgttggtgctcatcgtctccaccaaaatgcccacgtcgccgatggcgccccactgcacggccaggcctgtgggggagggggcaggtgggcagagctgcggggaggtcggggtggggagtggccactgggagagggtggggtgggcagggctgcggggagaaggtgggggtggggagtggccactgggagagggcagggtgggcagggtcgaggggagagggtggggcccacctgggaggccttcgtgccggcgtttctcacagatacgctccatggcggaattggcaaagccgtagttgctctgtcccgcattgccacgcccgcagctcacagaggagaagaccacaaagtagtccagctcagggcacgcctctcgggtcaccctgtgggcacgcgtgtcactccccattggccagcatccccaggagcccccaacgtcccatccccaggaaacgccagagagggctgtcaacaaaccaccttggctcccacggccctgagcccagagcccggcagaggcgggagcagggctgtgcggtacccacctgtccaggttcagggtgccgctgtacttgggcttgcagacgtcctggaagaactctggggtctggttctccagcaagccatctctcaagacctgggggaggcatcctcagcactccctgcagctccagggcctcacccgtccacccagggtcccccccttggtcttggggcttttgagggccccatttggggccttccctcaccacggccaggttgaagacgccgcccacgggcccaagctgcgccgcctcggcaatgaggccccgggccccctccagtgagctgatgttgctggtggacacctgcacctgtacgccctggcgcctccaccggcggacctgcttggcctggtagcctgcgggacacaggactgtgggctggactgggccagggtacggtctcttccctacacgccgggctggggaagtggggagcagccgcagagccccatccagcaagccccccacaagatggagggggacagaccccaggcaccgtgacagcccacaatggtgggctgcagagaagggctcaggggcccggggctgtgcctggcccaggctggtccacaagcacccctgccgactcacctgtccggatcccggagcgagaagtcaacacgagcttctgcaccccacgctgtatcagccactgcgccaactccaggccgaagccacccagaccaccagcgatgatgtagctcttgtgggccgggcagaaggtcttggagatggccgacatcagcttgggtttggcccccttcagcactgcctccggctcctccgcaagcacctgcgtccaagcagcacccaccggctcaggcactgcctggggaccagagcctggggtgcccgaggcgccgggactcctcccctcacctgcacgacgactttgccaatgtgcttcccttgggccatgtagcggaaggcgtcctccacctgggccccatggaacaccgtgcacttgaggggccgtaccaccccatcccggatgccggcctgcacaagcgcccacacctcccgccagtcagcactgctctcgttgaagaacgcatccagtaggaccccgtggaatgtcacgttcttcaggaagatagccatgcctgcgggcaggggccgtgctcacccagggccttccacaggtccacccacacccatccatgcccacccccgcccaggcgctgccggcctcaccgagcgggtggttctgagaaaggtcgaatttgccaatttccaggaagcgaccgtgcgtagccaagcacctcacgctggcctgcagcttctcttccgccaaggagttcaagaccaggtcaacgcctagggggccagaggggccagacaatcacacccactgcaagcccagccaccacagtccagagggccagaccctgcttctccctgggccggaggctaggcaggaggcaggtgggggctgtgggggccactcacccttcccgcccgtgtgccacagcacatgctgctcgaaggatgtgtcccgggagttggcgaagctggtgctgtcgagctgggggaacctggcctggaggtacgcccgcttctcagccgaccctggtgaagagaggaagcgcggctggtgagccagggcggcggggccaggagggcagcgggaggcaccgggggcggggccttacccacggtggtgaagacgcggcagcccagactgagggcgatggcgatggcggcctggcccacgccgcccgagcccgagtggatgagcagcgtctccccggggcgcacccgcccacgcaccaccagcgcgtagtaggccgtgctgtagacgacaggcaccgaggccgcctcctccagcgtcctggggatgcagcaggtgggtcagcacaggcctggccgccatccacgtggggcccaggctcacaccctcgacacactcaccagttggaaggcacatcccagaggaagtccggtgacagcaggacagaggtggccaggcccttggcaggcaccagtcccatcacacgcttgccgctggcgtctcggcccgagaactccatacctagcaggctgtcctgggaggtccacttccctgggggagacggcactgagcccctcaccgcctgcccttccctcccgaggggctcccaggcaggtcctagctgctggggtctctgctccccggcccagtccactcccacggccccatgccacccatacctgggatggcatcaggggacagcttgccagtggccagcatgatgtcgcggaagttgagggaggcgtagtagaccgtgcagagctgggcgccagggcaggtgggctgggcatggcgcagcgaggagcagacccagcggatggaggacaggtccccccgggtgagggtgctcacaaaggcatgtgccgtcggctcctcaggcttgtctagggaaacagggaggtggggctgctgcggggccttcgggtgcagtctcccgggaggggcagggcagtgtcgggggctcaccctcctccagcaggaagtggcggaaagccccccaggccccgtcgcggtagacgttcatcaccaggtctccctgcaacaccttctgcagttctgcggagcccgggtccacctccgggacgtgggaggtgctgctgaggttggagagcagcacacacctgggggcagaggcggggagctcaggctggggatggggaggctggtggggaaggggaagtggtgaggggccgtgctcctaccggaggcggttcccgccgggctctcggcggagacagttcaccaagcccaccacgcccgaggtggcacagttgatggccttcagccacacaggccgggaagagtcttcgtcagccaggatgccctacagcgggtcggggagggtcaggccacactcggcaagttgggaggtggggtggggcctggaggtggggcagggcctgaccttcagagactccacccagcggaagctggtatcgtccaccggcaggaagatggggctgtcctgcggggtgggccggcggcacaggaagagcgtggagccgtagaaggacttcttcaggcccaccaggcgcagcgacaccctggagaagaggctctcccacgcgtcctgtgggggcggtggtcagcaccctgcccgcctggccctcacccggcccccaccctgtccccctgcccggcggccgcacctggctcaggatgccctggccatactgcggctcagtggaggtgaggaaggccacgatgtccccgagggggtgcccccggagcagtgtgtgcaggagcagaaagcccccttctctcagggcagccaccatgttgctgagagctgaggccgggtccccgagggcagccacagcacagttgcacaccaggaggtcggcgctgcccagggcgctgggggcagggtctgcgggatcccactggccctgggcaacgtcgtgctgctgcagctcggcctgggcagcctccagggcctgggggtggcggtcggtggccgtgtagctcagctgcagcaggggatgggggctgagcaggcctgggatgcgggaatacaggtgaccgtggccagccagcacctgtagggggtgaattctggaatcagccccacaccaggcaggtgcccctgacctggggctgggcaaaatgtccatgaggcctcagtctggcagaaaggcttccccgtcaacctgatgacggtgccagccatgggcacgcatggatgccactggtcttgtccctggggtcctgcctaggctgcacctcttggagcccacgggcggaccctccacggtggctgtgtggaccgcacaggacacgtgcacagaaccacacagggaactggccggccccacccaccgcccagggcccgccccgtgtctgtgctgtctcctgcaactgatgtcagggtgggtcctaccatgtccggggcagaggcctggctgcccaggaggcacccacctccaccaccttcatcttcaggctgggcatgttctccacggcagtgtccaggcaggccttgagtgccggggagtccaggaggccgctgagcagagggtcctctggcagcttgggcctctcctgggccagcacctgcgccagctccagctgcaggttcccgttgagctgaagcctgcaggcagccgacaacagccggggcagttcctgctgtgaggggtcccgggggatctgggccccatccagtccgggcaccaccatcttcagcccctgctgggtcaccttggtctgcagtgcctgcaccagccctggggagggagggaggcaggcctggtgttcccaaagccccagggcatctgcctggcatgggctctcagacccactctgtccttctggggccaccaccccgctctgcccacaggatgagaaatagctgagggttgaggaaggggctgcccaccactgggaggctgactcctgcccactgtggacgcagtgaggggccgcattcagctgcaggggctactctgtgcctagccaaggtgtgaccttaggctgaatctgtcatctttgcccccaagtaccctttcaagactgaggaacagtgaccagggacgaggaaggctgggggctgggggagggagggaggccgccatcgtgagctccggccggagggttgggctagggttgctgaccccaaagggggccccgtggagaagcaagtctggggtcaacgtgaggggaggcgatcgctcctcatcgccagaggtgtccgaagccagcagggctgggacctcacccttgcacagttgcagctcctcctgcagggcagcgcgctcagacaggcacccctcctccgtgtggggagtgaagcaaaacttctccaggatgggcacctgctgctcctgctgccgccgcggggccgactcagtgtggagcccggagatgtggacgcctccggccactgtgaccctcagccacctgctcaccaccacgtcagccactgtggggacaggctgggtgagtgcggcatacttgggtgggggcactgggctggggctggggcggggctaccttgggccttgtcctgcagtgtgtacagcttctgcctgtgggtggcagggtcgatgtggatggcggtgacacgggtgggcaggtacaggccgtgcttggccgagcccaggatggacatctgcagcatggtgtccatgaagctcacccagttatccttccacagcagcctccccgagtcacctgcacacagggcctggttggtgctgtggaactcccaggtccctggggccacctcccagagcccaccgggcccctctgctccctcccaagctgcatgcctagctgtgggtgccctctgtggtccccacaatgacgaccgccctccccggtggcttgggcagcagtgtagtcagtacccaccttccaggctggcctccaggatgccctggaaatgagggccgtagtcgtagccacgcagacgcagctccttgtaaacttcagcctgggccaggaagaggggctccgtggggttgggggtggggctttccgggtggtcgaagagcctggggtcagggtcatcccactggtacaccttccctgtggaaagggaggtgcggaagggcctgaggacgggcggcatggccagcgggcacagcctccgcagctcccgtgccaccggccctgcttaccactcactaccaggttgccgttctctgacacctcgaaggcacgggaggcctccaggagccgtacctccagggacactgtccctgcagagcgggagagttggagatcagagggcagcacccgccccccagctacccccgccttggtcctggggtacccctcaccagtcttgggcaggatggtggcctggtgcagcaccacatcctcaaacaccacaggcagctgctcgacgcccaggcccagggcgcgggccagcgtcttccacactatgctcaggtagccagtggcggggaagaggacgcgaccgtcgagggtgtggtccaccaggtagtggtcaggagactcggagctggtgtctgcgggagggcacaggcctcagcacagagcgggcgtctgtggggagggaagagtctgcccacccgccgggcccctgctcaccgatgttgtagatggcggctgagggggaacctgaaccgttggggaagtcctcggcggccggcacgtcccaggccaggctgtggtcccacttgatgagtggggagatgaggggagttcctcggggagctgggaactccacaggtgggaacaaggcattggggttggcgtcgatgctacggagaagggaggcatgggtagcacacccgtcaccggggtccaggggctctgggttcagcccacccactgcctgcggtggaccatccagggctgctgccaccggcctgggtcagtgaggggcccgcagccccgctcacccaccccacgccgtccccgactccgggagacgagacccgggctgggaagggacccaccctgagaggtgcagcctgccgatgccggccaggaagaactccaggttgtccctgtgatccttcttcatcagggggatgatggtgcagctcggcttcaggccacgcttcaggacagcctgggggcggcagggcaggtgggctctcttggtgctcagctgaggcgcccatcccaggctcccggcgcctgctgcccccaggctgggcctacctgcagcagggcgtggggcgcgatctccagcaccaccgcgtgctcaggcacgtgccacagggcctcctggaacagcacagggctcaccaggttgttgacattgtactcggcggaggacgtgcgtgccaggctgctgtgccactgggcctcggggatagaggtgctgagccagcgggctgaacgtggcttcggctcccggatcacctgcatgaggggccaggtcagtgctgggttgtgggtcccctggcccgccccgcaccccccaggccgtattagtccaccttcttgagctcctgcagcagtgggggtgcgatggcctccatgaagtaggagtggaaggccataccgccggtccgcacctccttggcaaacacaccctccttcctcagctgctccacgaactcaaacaccggggcctggacatcgtgggagcctggataagcatcctggctgggcacccacctcaggctcggagaggtagggcgcacccacctcaccccaagggaaccgagagggaatgggcaagggacctgaggacaaacctgccccatgccccaggcccgtcagagcttggtggggcgtagaccgtggccgcgtgtccctgccagacttgcaatggcaggcgcaggggacagaggagcccgcccaggccgcagcacccacctgaggtcccgagatggtgactgtgtccttggagttgtggcaggcgggcaccacgcccggggggcagcgctgtttacactcctcccaggacaagcctatggcagagccagcctcagaggcttagcgtggacaccgagccgctcccagccacccacccacccagacactgcctgcagctgggggcagtaatgacaagtgtggtaatggcagccttggagccttcatgagaaaggttcgccccctgctgtgtttgacccgtgggtggaggtgtcattacagagctgccactccaggggcagctcctgggagcccagtccccagatggtggccccctcagtcctctgcagccaaggttctttccaggtcctgcccacatgtggcccatggggctcagagatgggtgccaacagagggcaccagtctgagggaaccctgatgacccgtgtgttggcttcaccagagcccctgggttcttgctatgctgcagctgtgtgctcatcacacgggggctccacgcaggcctgatgcccatggacacgtgcctaggcccaaggctgccaggtgtggggccagtggggcagctgcaggggactcgcgcacggctgtgtccgagctgggtgtccccgggccagcgggggccactctatcctacgggggccaggccagggctgcaggtgaggaccccacagcgagaaggcagcctcctttcttggaggtgctgggggcccctccgggagacctacccacggctgccatggcgcccggcgggagatgggcttctttgatgcactgtcccctccagtaggcagcgaggacggcctcctcctgggacaggcagccgtcggcgtagccacaggccacctcccccagggagtggccgacgatgccatctggcctcagccccatgcagctcagcaggtctatgaggcctatctggggtgggaacaggacactcaggttgcaacctccagcaggtgcagctgttgggggcggcccccggccccactaggccatctccacccccgcgccccatcgaccctcccaggtctcctgataggaaagaagcccctatggcccccacacagccccactgagacccctcctcccctcccgtcctgcccccagcacaaggctctgcctagcaaaggggctgtcaggggccccggactcaacactgcagctcctgggctccagggaaagccagagccctggggctggcgttgctcacacgctggcaggctgggccctacctggatggcagtcaggctcacaaacgaatggacgatgtcatcaaaggtgctctcgtctgtgctcagcagcagctgtgacaccttcaggccgaatggcttcacagcctcatcggagcgtaggatggaatctcggaagcggtccaggcgcatgaggctcagccccatcccgcgccactgtgtgcccatccctgtcccagagagcacgtcacgaggctcagccccatcccgtgccactgtgtgcccatccccgtcccagagagcacctcaggggaccaccagctccagttcgcctgcctttccccagggaagggaccaccttgggggcagagtgtgggctcaccagagcagatgaaccagagcgggcgctcgccagcgggcacctgctgcacctctgggccaccgcgctcaccacccagcacagcgtagccacggaagggcatggcggtggcggggacagccgcgatgtcgttcagcatgctcaggaaagccaggtcctggctgtgccggaggccctgctccagcagcttctgcacggcctcaggggtgcgtccgctggcccgcagcagacggggcagggtggcatgtggggcgggtgcggggggcggctgcgtgttgggcctcaggatgatgtgcacgttggagcccccgaagccaaaggagttgatgcccacgttgccgccacggacgggcaggggctggtccaccacctgcagccgcccatccaacagcgctgggatctcagggttggggctatggaagtgcaggttgggggcccagagcccgtgctccagggacagcagcacctgcgggggtacgtggtggatgggcagccgccccactccctctaccactgcctgagctgggggcaggcacctccccgagactctcatgtggggccagggttccagggccctctccgatgcacttcctgtccccaacctaattctgccatggcacaggggtccgaggactgagccgccatggccctgccctcagcttggtccaagacctccccttccggccttgctgcctcccagcctgatgtggacccaccaaagcctggctgtggcctgaacactaaggcccccttggcccagatgttgcatctcagaggctgcagaagttggggggcagagggcgtgagtgatcatgggtgttggggctcctgtgcctggtctctctaaaggtccccaggcctctgctagtgggtcaggaagctgtagggacgggtgggcgacacgggagaccctgatggtgccgtggacccccccaggcctgctcctgcctcgctcttcccacccaagcggctcctccagctcggctccgtgtccggcagacgctctgcagggcatcaggcctccagggaaggcccagcgagcctggctacgagctctccctgctgtcagcctcagtgcctctgctcagacctgcagcatagcccgggggacagaggctcctggtggggaagcccccgcctccacttggcaaagagaaagcagcagtgcccagccatggcgcaacccagtcccagggagcaggagcctgagggacccccaagcccagccccacctaccttggccagggctgccagccccgaggctggctccgggtgccccatgttggacttggtggagccgatgagcagcggctcctggcgggtggcgcacagggctcgggtgatgccattcagctcctgggggtcgcccacctgtgggaaacatggggggtgaggggctctggccaggtcacctctccaggcatgggcgtaggttaggctcatggggtggtgagtggggcggggggggggggcatcaccttggtgcctgtgccgtgggcttcgatgtattcaaatgactcaggggccactccggccgactggtacaacgagcggatgagctgctcctggatatcccctgaggggaaggtcacgcctgcggagggctcggctcagtgctgcagccccagccccggctcccacctgccccccagcaccccggaaccccggcagagcccaccttgctccttgaagccatctgtattggtgccggcgttcaggatggtggcgtacacccgccgggccagggacttcttggtcagcaggacggccaccacaccctccgagcggcagtacccattccctgggtagagcagcacctcaggcccggggctcagccccacgccggcccccaccccaccaggaggagctctggggtgtggggtgggtgcttgggtgggggatccccggagctggcaggatcctgctcagcgtggggactgtgcggggggccgtcctgtgccactgtcccgcctgccctggccgcgcagccgcacactcacccgctgtgtcgaaggccttgcaggtgccctcggggctgagcatccccagcctcaagaactgcacggaggtgttgggcttcagcaggacattgatgccccccacgatggcggcagggcactgcccgctgtggatggcctggtaggcgttctgcagggccatcaggctggaggagcaggctgtgtccagtgcgatgctgggccctgcaaggaagggtgctgcggctcaggtggggctgtgagcacacgagacccctgagcacacctcctgccaccaggctggacacacactgcacggagtgagcccacgccacgtggtttctgctcagcatgtggggacctgaaggccacccacctccgcaggaggctgggcaggacccacctctgaagtcgaagaagaaggagagccggttggccatcatcgctcgctggcagcccaccatgctgtagcccacgagtgtctcggggtctcggctcagggcctccgaggtctcagagccgctcacgcccacccagacgccagtgtgtgttcctcggagtgaatctgggttgatgcctgccacaaacagtggtcaaggtgccacggccgggccccacagcgcagccagcccacccacccacccggctctggggcgaaggtcccatcttggcctcactggcttggggtgagggggggtccatcccagtgggaccctggaaggggcctaaggagggtgaggtgtcctgcagaggggccagaacagagcctgtggccagcagccagcccaggtgaggcctggaacaggaaccaggtcacagagggaacgaggcggagggggcaggcgggcccaggggagggcaccaggcacggccagagtggctccaggaaggacagagggcagcattgtccccaggcgacgcctttggcccctggtgtcaccggcagctctgatgagcccgtcggccagtggcctctccagcgccaagggcagcctgcaccagaacaggccgtgataaggaaccgaggagacaaaggccaagtgtccaggctcgggaaggagagagggacaccggtcacccccggggagcataaccttagtcttggggtggggtctggcagcaggaagggcgcaggagaagggcttccacctctcggccagcagggcccctcctcgcccctggtgggctggctctgccctagggtgggtgggtgtgtgaaccgctcacacccaagggcagcccagggctcagcctccccctcaggaggtccttctccgcccggggagggagcacctggatcttaagaaatggcatggctgggcgtggtggctcatgcctgtaatcccagcactttgggaagctgagatggatggatcacgaggtcaagagatcgagaccatcctggcaaacatggtgaaaccccatctctactaaaaatacaaaaattagccgggcgtggtggtgggcgcctgtagtcccggccactcaggagactgaggcaggagaatggtgtgaacccaggaggcagagcttgcagtgagctgagatcgcgccactgcactccaacctggtgacagagtgagactccgtcttaaaaataaataaataaataaaaataaaaataaaaaaacggcgtggcgcttgtccgaggtcaaatgccagtcagagcgagggccaggctggcgggagagggttgaaatgcctggggtggggggacgtgggcaagggtagtggggagggtgggaggggagagacagcagggccggtgctgtccgctgcttggctggtgggggtgggggcctggagggcccctcaagaacctcctgctttgcctctcgtcactccagccccggccccggccccagcaccagccagacatcagaagcgaggagactggtacgctcaggtcagggcacacccgcgacacctctggggtgcagttgggaaactgcggcctaccccgtggcccacacctccctgagcccgttggccaggccaggggcacagccggggagggtaggtggtgccagcacctggttctaccagaaccaagaagagaaaacactgcctattccacgtgagcagcaggagccctcggcgcagcagtcgcgaatgcccgacccacctccgtccacgatggcttcataggtgacttccagcagcagccgcagctgagggtccatcgtgtgtgcctgcttggggtggactccgaagaaggaggcatcaaacctagacaggtccttcagcttgccggaccgccggggcaggccgtagagccctgtgggacaggcgggtgtttaaatctctgacggaagctgcccagaggtgggggccctgtggggtgctgcaggcccctggaggggccatggtggaactgaggactctctgctatgcctgggaggcccaaacaatggagcaggctccccaggaggggaagaccatggccccaaagcggggactggtacgaccagatctgctgcacaagccccaagccccaagccccaatcctgagatgggccgcagagcagagagctcggcgggagtgaggctgggggaccatctgccgggctggtgcctcggctctaccatgctgactcacagcttgcctgtcaggtagagctgctctgtggaagagcctactgggtgtggggcagttgctccagcctcccggagcacatctggtatgcaacctcccagctcaggacagacacaggcaggggcagcctggccggaagggctctggccccccgcaccccctgcatgggtgagagaccccagcccgtcacccatcctctgagcttggctcctccgtaacaagcagatgggccctgcctgggccagccctcggccttgcagccattgggggagcctcctgttggccttgcagccgttgagggaacctcctggcaggctgggcgcattttctaggccactctggtgcaatgtccaggaaggaggctgcagctaggcctcgcccatgggtgaccagtggctctgcagctgggaccggcctcaggccagtgcctgggtggtgaggacacagcacagcagggaggctgctgtgaggacaaaggtggagatggagcttcacaccccaggcacggggagccccgcagccacatacccgccttccagcgacggtcatcgtccgtgaccatgtccacaccgccgatgaggttgtcccagaactcctgcaagttctccgactctggcagcttcccggacatgccggcaatcaccacctcctccatggctgctctgcagggcgggcggtgtgagtgccccacacatcccggccacgacacccccgtcaacagcctcggcacccagaacaggtggacacccatggggccaagcaccaccctgagggtccgtgcgggccctggctcctgcggctcccttcctcatgtggccagttcctgggccctgaccccgctctcgctgggaggggctgcgtgctctgggaacaggcccgcctctgggccctgacccattcagttcagggtattggctggggtaccccactggagccctgcagccctggcctccccagcagttactggtttctgcgcctgtgtcggcttccactcgcctgagtctcagccttccaaggctcctggagcttgtcccaggccatccctagggcaccagggggctcacagtgaggagcaggcagggtcacctgagatggggacaaggcctcaggtggccagcctgctaagggccatcaaagaaatggagaggcagggtcccaaagccggggcatggaggtggctgggagccctagaggggggtactcagcacccatgctcacccgtgttggggtgggggcccgctgtccaggccagcccaagagccaccagggctggggagggacgaaatggggatagcctatgctctgggggaaaggtggcccctgccccactgtggaccgacccagccagtccaacccctccagcagggtccaacctggagaaccactcctggccaggacacgcaggtgttgcctggcacccttcacctgcgcgggtgaacccacagacgcttgcctccccataccaacccacacaccacaggaggccctccctggagcccaggtccctaagacccggaacgggtgcccaggccgccggctcctcctccagcatgagggctggtgcggccctggggggagggggcggaggccagcgctggtctggccacttgcacgaggccccagggcctgatacgcgcgccgcccctcggcagtgcggcctcccttgggccgtcccggcagggaggcggccgccttcccacccgctgcgattcacagaggcttggctgccccgggccagctccaggcccgcacgctgggtcctcgccgcttgctattcacgcggggtcgacggccaggcagggggtgggaacaccgcggcgcgcccggcctcccttcgccccgggcgggggctgctcgggacccctgcgcttcggccgggctgcgccacgtgatggggaggccggtcccggcgcggcccctgcgcccccccgttcctccctcgcggcgtccccttcgggctgggcctcggctccggggcggctccgggaggaggatgcggcggcgcctttgtgggcgcggggaggccgagccgggggctcctccaggcccttcagggtccgcggcctcccccacgggaagcgaaggcggctgttggtggctttccccggcgtccttcccccgccatccgcccacctactccgcggggccccgggcgcctccgaaggggcacgaacaccgagacccggacaggccgcccaggcgacccctggatacggggccgggccacgcgcgccccgagagcggaggatgaggagccgggccaccccgggaaccccgggcccagccccgaccacgacccgcgccccggccccagcgccggctgctcgtacctggtgagggcgcgggcggcggtgcgggcggcggagagcgaggctggagcgcggcggagcgggaggctgaagcgcggcggagagggaggccggggccgctgccgtctctc

SEQ ID NO: 716 - DNA, 5585 bp, Homo sapiens
cgctgccccggaagtggacggcacgccgcggcggggtgggtgcaagatgccgctgccggttcaggtgtttaacttgcaggtaacgagccgaggccgccccgggcctccgcgcccccgcgccccccgccactggggccgggctgaggtcgagcaggggcgcggggcctgcgccaggagtcggtcgggcacgctccgtgccgggcctccgcgggcagcgcgcgtcgggggctgcagggccgagggcgcgtctccgccgtggctgcgcgctgcgatcgggggccgccgggccgcgcccgccccgcctcccctcccagcagctcacgggagaggttcccggccgccccgacgctaacgctctttctcccttcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgaggtaccttccaggacagggacccccgagcgagggaggggggagcagggccccggccgcccctgctgtggctgggcccctgctgctctgctggccgaggacagggactcagtgccaagcgcaggaggggagggagccccggtgggcccggggcctgcggagggagccgagctcttggtgcttttcccgaaggagcgcgggaggcccacgggtccggcgagtgcccggcatggcggcttttccagcctgctttgtgttaagccgaggtcctggcttctctgtgtctcccagctgggggccatgaggctccctgagatgactcttttccccttctcccaactccgtggcgtgactctcagcccagtattgctgctccgctgctcaggacagattccgggggctggtcctcctgcctcctggggttgaggtggcgtcccgttcttctccgtggcttggaggaaactacatcaggatggtggctgggaacgtgtaggggccctcagaggcccctgtgtagttggttgtcccctgtctgctttctggctttcagagatgagcggctagaatcaggcgaggggtttctgcttctgagccttagagtcttgtgaggagacccctccctgatgtggtggcacaggagcctgggtgggggcgggggtgactgggagggcacacctgggggacagcagcggcgggagtgtggtccgactggcctggaagatcttgggcagagctgacctcagagaacagtgcgggtctctcgccctcctggggcagtccccaggacgaggtgccaggtgcctggcccatgttgcagggggccgtggagcccatgcagatcgacgtggacccccaggaagacccgcagaatgcacctgacgtcaactacgtggtggagaaccccagcctggtacggagcccagtggggggaccttgggtgtctcagtcctgctgaggggtccagggcacactccccgctgcagcctgcacagcaggtagaatgatcctcctcagtgatcgctgtcgtctttttctgaccccgaaaccatcagcgtttctgattgcgcactcacatgaggcttgtagctcagcttcagatgctgctcatggagaagccagggcaggtctcctccccgctcagcctagcgaccagcagtcactagtgggtgtctatccccgaaagcccccgggtgcagggtcccactcctgaggctcctgcgccaggcccaccccagcggtcttcgtagctcctgggacagcagtcagtctcgtacccccatgcccggttctggttatgggcccagggcgacattctggctaggacagtcaggccccaactcctgaccctcagggcctggggccagggtcctgcctcccatcctgcctgactcttgtctgtgcctgctcccaggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtgaggccaggggcttggcgagaggaagcagaggccaccaagggagcgcgggtgtctgggactgggcccccttcctgtgccctgcatctcccacccctgtgctgggaagtcgggcgggtagagctctcgctctcttttggccagcagtggaagtgccctgtgtgtgtgtggcttctgtgtgtgtgcatgcagggctttgattccaaggggagctgttggagactgtggctcaggggccgcctccctgctggtttccccacccggctgtaggctcctggggcagcagttctctctgtggccctggtgcagactggtccctagaggtggggtttgaggccagcgggaggtgcccacctgtgtgccggttgggcctttgagggcagcctgagattggcggcttcctcccctcctccctggcccccgtgaccgccgccatcctgatggccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcggcctgcctcggcgggcgggggtgggcagcatggctgggccattggggcgcccgggctcacttggctctgcgcccccccgccaggtcagcgtctacttgcagaattggtctcatgtgctcagctacgtcagcaaggctgagtccaccccagagattgccgaggtacgggccacctcctcagagaccttgcccccaggattcctgaccactgctggcccctcctgtcctcccccacctcattctcccccagatctgaatctgccttcatcccctctcagtctgggggctgggcatcgagctctaggaaatgtggagcatgggcctcacgcatgtggcttcctcctacagcagcgaggagagcgtgacagccagacccaggccatcctcaccaagctcaagtgtgccgcaggtgagggcctgggtcacgcccagctgaccccacgttcccctgttgctaagtcctcccagcccagggcagtaggctggtccctgcctcagccagggaaaacttccctggcagggcgcaggatgttgtgggcacatgtacaggtgtaggtggtgcctaaagtctgccccggggaagccagtgggtgacgtgtggtcagggtctggctgctgtcactgtgggcgtgaggcaggtctgccagcccgagctgctctgaactggggtgtcctttgcagccctgctagcacctagggcttccctgcatgcctggcttcagggagcctcctcagcattggtggggctctttccacccgtgactagagtatctgtccccagcgctgaggaacagctcccggggcaggagaggccagcgagccggctggtggtcgcgttctccctggtttccaggcgttagcggcttccccaggctctggggtcttaccccctctcccccctccccgcccccggctccttccactaggcttggcagagctggccgccaggaagtacaagcaggctgccaagtgcctcctgctggcttcctttgatcactgtgacttccctgaggtgaggagccctctggggacttgggaggcagagcatgggctcatgggtcaggctgcttctgtaggagggtgaggtctctcacaaatggggtcttaggcattctccgagcgggtgatgggcaggcaggggtggcctggcccttcactgcctgtgacgccaggtctctgctcctcagctgctgtcccccagcaacgtggccatctacggtggcctgtgcgccttggctacctttgaccggcaggagctgcagcgcaatgtcatctccagcaggtaggtgccccggtcctgcagccctgaaggctgtccccgtccctctccgtggctgctgcttcggccttgcatgtcctggccccctggccccagcgttttctcaggtgtttgtctggggactggtgtcccactggccacttggagggaggggcaggcagaggacagagttctgaggggtctgcctcaccagctccttcaagttgttcttggagctggagccacaggtccgagacatcatcttcaaattctacgagtccaagtacgcctcatgtctcaagatgctggacgagatgaaggtgggccccgcctggggtaggggtgaggtggggccctgcctggcctcctgtcctggtcctgaccagccccttccccaggacaacctgctcctggacatgtatctggccccccatgtcaggaccctgtacacccagattcgcaaccgtgccctcatccaggtaagcgtgggggtcaggctggcacacggcaggcgggcatgcagggggctgtggagctgacttccctctgccctgcagtatttcagcccctacgtgtcagccgacatgcataggatggcggcagccttcaataccacggtggccgccctggaggacgagctgacgcagctaatcctggaggggctgatcagtgcccgtgtggactcacacagcaaggtggctgtgggctgcggggcggtgggggcagctgggggtgagcctgggccccgctgagcttgtgcctgcacagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaaggtgggctggcttgagggggggcaggcgcacggcgtgtggggcctggtggctgtgagctgctccttgtctcccctgcagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 717 - DNA, 7951 bp, Homo sapiens
gggctctcgcatctttgaaatgatttattgttcacttttgcacacgcgtgctgaggacagggcaggtccagcctggggcctgctccccactgcagcatttccaggcccccagagtgggccgaagggggacatgggcgtgtctttccacattaagtagcaggagattccctgagtaaaaggcattttcttaagtaggacgtgtccaggctccagcagcagtcctgggggtgggggttgtgggccttcaggccagggcactgcccatgacttcggagaagccacctggtgttccaggtgctgctggctgaggctcctgcagctcaggctgggcctctttccaggccagagacttctccaatttggttttaaaaagcaatccgtgacctggcagagcgagtgagaggagtcgggggtcaggaggcggagggggtctgtttgcctgctgcggggcgggtggtaggcgccctcacctgggcagtctgcagtctctttggaggctcgcttcttgcagcagccgcggcacaggctgaacacacatctgttgccctgggcacaggaaatctcgggagcctgtggccagcaccactcccggggccaggctggccagcaggggagcagccccactggggaagcctctgccagatgcccacggcctggatgcagccctgggaactgctcccaagccagatgcctctccctcacccccacccacccagactctcttcccctccaggcctgggcaggggcttggctggaagcaaggggccgtcctgaggcatccatgccaccttgagccacgttgcaaacccagctgggcgggcaccagacctgccaccccaagcagtgcagagaccaccctgcccacccccaaagctgaagccttggtggcttgcagccggaacccactcacctttgggtttccacactggtcacactttgcatattttgctaggaaaagaacaaaagggtgctggtgagtgagggccagggtgccctggctgtgggggctgccccgtccgcctgcacggagcctgctgatggcgtccatgccagctgtggccagccaggccaggaggctcagggagggcagaggatgcaggctggccacgtctgcttttccttccgtgagcaatgggtgaggggatgcagggggcaccatcctgcaggaaacggataggaagcaggtgggctggggggccgccgcaggacgagcagccttatctgtcctacccccaggcagggacaaggggagcagttttcctgcccacagggtccaaggggggttccatgcccttcagttccaggtctcccaagcaaaagggccaagaagggtcaaatcaagaattcagcctgaagccccacttcctgcctctcccagctgcctcattcagtggcctggtggggggcagtgtggcaggcagggactgctggcaccagcctgatgtggcagctgctcttggactggccagcgccctgggggttacatgggaaggtttcagggttatcgctggtctcccctgcagcttgtaaagttgtcagagatctgggaggctgccacctgttgagggcccagatgggctggcccaggatacggcggcgaccaggggtctcaggggagacagcactaggctgaggccttgccactggtggctaagagaggggcgagcagcctcgtcccgtgcctttggcccagcaacaagacccatgcacacactcccggggaccccagcctccctctcagcagctgctcaggtgtcctgtgtgaggctgggcaggggcagccgcagggacccgaggccctgagctgtagacgagcttcacctggctgaaaagcttgtcccatagcctcatctgattcactgagcccatgtcccacatgcacgggctgtggcctgcacagggtccccgttctgaccccaagtctggctgactactccgccaagccctccaggtgtctgcttccagctctgggccttgagccttgctgaccacaagtctgggttcctgttactggcaacagggaggatgggggtgatgaagaggctctctcgggcccatcagcggaagcagcacttacgcttcagagaggggtcgaaggtcttgtgggggttcctcagctgcttcttttgcttgttcttggacaggacctccgtgccaccctcctcttcctccagggcccgcttgctgcgcgcacctgccttctccttgctcccctccctgggcctgaggggagggcagcgggcagagcccaaggacactgtgagaggggcccagcagccacagccacacgggtctgagtctgggtgaggggccaggcggccgtggcgagtgccgctgctgtgaggagtgccctcctttccctcgggcagcccattcaggactcgtcactagggagtccggggcctctgagatggagtccgcagctcgggcagccccaagctctgaaccaccagctccagggagggctgtggccacggatggcctcacctctgagaacccagcagaagctggggtcaacctcttgacccacgggcaaatccaccaggatcagaggagctcagagaagtatgttatggaagaaaagatttaaaatccgagcgtccactgagggaggacacagctgagccaccagcatcctccaccaaggacaccgaggggcacgtggaaggtgtgtgctgctcggagccgaggcctccctcctcctttcccttgggcaggagatgactgaccataatggctgaggacaagcagggcaggcgcagcactgtgggcacagggtggagcccacaccttggtgcacatccccgcccagggctggctgggctctcaccccggccggatgtagggctggcagatccagtggaagggcaagtcgccggtgggcttcgctccctcctgcctggatatctcctcctgcaaaagcccaaggccctggtcatggccccagcccctcaccccctgcaaggccgggctcccaccagccccagcacctgcctgacaccgcagcttcagctcctggctcacagcagcgatgccctccagggtcttcaccttggccagctcctctcgcagctcctggtgcacctgcagcctgagacagaggccctgtcacgcaggctgggctcccggctccaccgtcaggccccaggctgagcactgggcacacggggacctgtgtctcttcctgcccaactccactcctaagtcaccccagcccctcaagacctgacttagcagcaagttgttttgacaaaacctgcaaaatgccccaggtggggtctgacggaatctgcctgggcggccctccaacgtggcttctgccttagggggcaactcacgtgtggtgccacagcttgaagaggtgggcccggacgtaggacagggggcaggggtgctcccgcacgatgtccagatactcctcggccagctcccacacggcagggctccggccctcgaacagggcggggttgtgcaggttgccctctgtgggaggaggagcggggaaggacacctcgtgggttgctccaggtggacggcacaggaaagcctgggacactcaggacacccttctgtgccacctcacaagggacaaggccagctcaggcccatcagagcagactgggattgatgaacaccatctgtgaacagcaccatggggagggcagtaggcagtgggaggcaccgacctgggcggtggtatcaggccgtgtgcatggggccctggctgctgtcctgggccctgcccacctgcgctcatgacgccctgcacacccgtgtcccggaggcagcgctccacgtcctgcaggcactggatgttcccgttagcaaacacagggatggccacagccttcctgttggcagagaaatgcctgtttccacccgcccggaacagcacccaggtgatgctgcccccagccacggccccctgggtggtcacgggcgtcaggcgtgccgagcaccctgaggtgtggagctgggacccccagcaaagccccaaggactgagggctgtgtcacccacacccactcaccgcacagccttgatatgctcccaggacgctgcacccgacaggggccccttctgctccttggtgcgtccgtgcaccgtcagcaactaggacagagcagtggtcgcttgacccctccaagccccttccgcccctcagagccccctccgcccctccacgccccctctgcccctactccacccctccgagccccctctgcccctcccagccctgtgccccatgcccgactgcagggacctttccctcaccatatcagctcctgaagcagggctgaggaatggccatctggggcctaccccaaggcctctgcactctgtgggaacctcaggctgcatgtgctgcccaggcccatgcaagagccaggccgggaagtggcagcatccccactgcccaaggccaaaggtgtgggagggactgactccaggctagtggggcactgggggggaaagtgggtcctgggcctggcagcccctgtgcaagctcatccccgggtcaccaaggttgctgtccaccttcagaaggtgagtgtcttgaggggcacccccggagacagcagcccatccaggcccgcgccaggccaggctcagtgtgcggggaacacgggcaggggagcagctctgctgacagcctggtggccccttcctcaccctctagggagactggatgctgagtatccccaaaggaggccctgccggcctctgtgacactaggaatatgtcagagatgccgacattactctctccacagggacaaaaccctggagccaggaaagcagtttctgttgtagaggcctgggcttggggtggtggcactcagagccagtggggacaggccagtcaggagggccactgcccccatgaggccgacggtgcacggtgtctggacacaggaagagcctcagctatgtcctctgcgcaaaggcccagctgaggcccatgacacccccgcgagcccagggctcacctggcagccggccttctccagcatctgggcgtacctcacggtcttgtcaatctccgggaagacacggattttgcacgtgacaggaacagagagtttctcgtgggccagcaaaactggggagaagagaggcagcttctgagggggccatggtgttcccactttagcggccaagccccagagcccagggccctgcagacagcggagcccaggcagctttgccgggaggctgggaggcagcccgggccaccatctgggtgtctccctcaggttgctgggcaggctccctccgccatacccccggccctccgaagttcaaacaagcagggccaaggccggctctgtctcccaggacatctggggctgggcccgagcaaggactctgccctggcacctactgtctggttttaaggggtgggtggtgcaggacaggcaacttcacagccacctccttccagcagagaggctgctgtgggcaggaagccccagggtgatgctgagaactcctgccaacgcctgtcctctcctgagccccaaccaagtggacagtgcccatgtgtccctcttgagggtctctgggggtccttcaccatccacccagccaactcactcattctttggagcaggtcccactcgtcctgcagaaaggcgccatagtgacctgcaaggagcaagcatggcctggctggcacctgtgttaaggctggtggggccgaagccttgcaccccctctgcaccctttcctgcatccacgcaggccaggagctgccctgtcaggcgggacacaggtccccagaaccagcagtgtctccagttggggcagtgggacagtcagagcagtggtttgtcggcatcagactcaggggctctatttgcccagctgcctaagctcagaaggtgctgaatggaacccccaccctgcacggtctggaaccaagtaacacctcctcaggggcccggtgaggtagcaggctcagccccacacacagcagtgcaagggggtaatggggaccctgtatcagcaatcatgtttatgcagagggagctccctgagggaagagagagccagtagggctcggcccctagcccccaaggcctgaggacagccaccctccagaggcggagcacagaggacagctggctccagcctgagccactgtcacgacagaggcagggcctgccgtcctccaagctcaccacacctggggctgcactgagctggctctggcccctgccccaggtgcccccatgctccacatggagctcacctctcttggctatcatctgtgggcagcccaagttcaggtcaatggcgtcacagtaatcctgagccaggagagccgcctgaacaaacacctccgggtcattggcacagaactggagaagatgcaggagtcagccacgggcccagccaggccctagtcccttgctgcccagccctacgagaggtccagtgtgaccccatgagggtgtgggcccaggttcactgcaggagggtgctctgtcctgcggaggcttacaatatgacaaagccgggaggagtccccaagccacccggatttacagattttcttctgaactgtggcagaagccacaatcactgacttctgaagagcagagccatctccactggttctgaagagggagtgtgagtgtgagaggcagcaatccagaggccccagcagggctgcaaacctcacagcacccaggctgcctgagccactcctagagaatggggttggattctggcaggtgcacctggcagccctggctccaccacaggaatcactgctgtggctacgtggactctacatgcctggtgccaccttctccctctcctcctggaattgagctgtctctggaaaggctgaaagtgatgtcccgccacagagagaagggtttttccccaggcattccaggaccgggaacccaaccgcggccgcggccacagcccctcctgcgcacctgcacgatgaggggccggtcctcggggcacacctcgcagtacaggttctccttccggtagttggcgtcgcggacaaagacctgggcatgcagcatgggcgtgtagcagagctgtgccccgtggcgccggctcagcagcctccaggccagctcgctctggtccaccatgggggccacgacgtggcgggcccctcgcagggtgcggctccagaactcgaagccctgcagctttggcatcgtctccaggctgggggaaaggcgcagacccggggttcagccaggcccaacgaggggcttaagactcaactcagaggcagcggtcacccttctaaggccgctccagtaccaccgttgggtcacacgcgggggcactaaaggcgggggtcggtgcaggctggagaacggccactccagtgccgccacctcctagcggacctcgggggagccgctggacccctgggacttgaccctccctggggagcgggactcgatgtcggcctggtaggggactggcgtgaagggggaagaaaccttgacgccagcgtccccgcgggcctggccctgagcaggccgcccggcggtgaagttaggacccccggccccttcccgggagaatcggctccgcgccgggccaggggaagggcagagcttccttctccgcacccggccaggcggcccggctggcccgaaacgccacaggggcgcccctcgcgagactcctccggagccacgcggcgggcagcgtttgctgtgtgaagtgacaggagcccacacgcctccgcgtcctcaccgcgcgagggccccgccgtgtccgccgcgcgcctttggctccgagggcgccgggtgccggtgtcccgggcccgcccctctccggcctcgccgccgcccggggcccctgcagctcccggggcgccgcgaacgcccgcaccgcgccggggccgccgccgggccgcagccgggcccaaggctccgcgccgccaccggaaggtgcccggtcct

SEQ ID NO: 718 - DNA, 5585 bp, Homo sapiens; identical to SEQ ID NO: 716

SEQ ID NO: 719 - DNA, 17884 bp, Homo sapiens
ccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccata

SEQ ID NO: 720 - DNA, 13675 bp, Homo sapiens
tttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaaga

SEQ ID NO: 721 - DNA, 4771 bp, Homo sapiens
gatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggacgccgggaggcggggcctggccgagctgcgcacacccgggtggttctggctacgggtacccggacctgcccaacgaccgttctccattcccgacctccgcaccctacccggtccgcagggcaccttcctcctctctctcaggcacgtcctcgacctcagttgccacgtgcacatgctggtgccttccaggtcggtctttctccaccagactccacctggaactttcttccttttcgtcctgtgctggcctaacccctgctcggcctcggccctcagctgccggctctaacaaagcctctgtctttcccagacccctgtgaccaggtcaggctctgctccctgcgttcctctctccttgcttccctcctcctcccctccccagaatcgcttgaacctgggaggcagacgttgcagtgagctgagatcgcaccattgcactccagcctgggtgacaagagcgagactccatctcaaaacaaaaaacaaaaaacacaactcttgctggctccttgattttagcccagtgagattcacttctaatttctttttttctttgagacagtctgttctgtcacccaggctggagtgcagtggcgtaatcatggctcactgcagcctcaaccttcctggactcaagtgaaccttccacctcagcctcccaggtagccgggactacaggggtgcaccagcatgcctggctaatttttgcattttttgtagagatggggtttcactatgttgcccaggctggtctgaaactcctgtgccccagcagtcctcctgccttggtctcccaaagttctgagattacaggcatgagccactgcgcctgggcttccatttctgatttccaaaactctaggataataaatttacattgttttaagccaccaaattgtagtaatctgttacagcagcaataagaaatgaatacagccatgcttgataattcctttatcaaaagctacctattggtgttaggaagtattgttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctca

SEQ ID NO: 722 - DNA, 13675 bp, Homo sapiens; identical to SEQ ID NO: 720

SEQ ID NO: 723 - DNA, 4771 bp, Homo sapiens; identical to SEQ ID NO: 721

SEQ ID NO: 724 - DNA, 4771 bp, Homo sapiens; identical to SEQ ID NO: 721

SEQ ID NO: 725 - DNA, 1666 bp, Homo sapiens
ctcaaggttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggac

SEQ ID NO: 726 - DNA, 51831 bp, Homo sapiens
atagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 727 - DNA, 41344 bp, Homo sapiens
tagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 728 - DNA, 51831 bp, Homo sapiens; identical to SEQ ID NO: 726

SEQ ID NO: 729 - DNA, 51831 bp, Homo sapiens; identical to SEQ ID NO: 726

SEQ ID NO: 730 - DNA, 51831 bp, Homo sapiens; identical to SEQ ID NO: 726

SEQ ID NO: 731 - DNA, 51831 bp, Homo sapiens; identical to SEQ ID NO: 726
